United States Patent 12,577,609 (METHODS FOR CELL-TYPE SPECIFIC PROFILING TO IDENTIFY DRUG TARGETS) - sequence listing, part 20

SEQ ID NO: 36821 - protein, 2182 aa, Homo sapiens
  ENSP00000364547
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHVCESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 36822 - protein, 548 aa, Homo sapiens
  ENSP00000479104
MEEDLFQLRQLPVVKFRRTGESARSEDDTASGEHEVQIEGVHVGLEAVELDDGAAVPKEFANPTDDTFMVEDAVEAIGFGKFQWKLSVLTGLAWMADAMEMMILSILAPQLHCEWRLPSWQVALLTSVVFVGMMSSSTLWGNISDQYGRKTGLKISVLWTLYYGILSAFAPVYSWILVLRGLVGFGIGGVPQSVTLYAEFLPMKARAKCILLIEVFWAIGTVFEVVLAVFVMPSLGWRWLLILSAVPLLLFAVLCFWLPESARYDVLSGNQEKAIATLKRIATENGAPMPLGKLIISRQEDRGKMRDLFTPHFRWTTLLLWFIWFSNAFSYYGLVLLTTELFQAGDVCGISSRKKAVEAKCSLACEYLSEEDYMDLLWTTLSEFPGVLVTLWIIDRLGRKKTMALCFVIFSFCSLLLFICVGRNVLTLLLFIARAFISGGFQAAYVYTPEVYPTATRALGLGTCSGMARVGALITPFIAQVMLESSVYLTLAVYSGCCLLAALASCFLPIETKGRGLQESSHREWGQEMVGRGMHGAGVTRSNSGSQE

SEQ ID NO: 36823 - protein, 104 aa, Homo sapiens
  ENSP00000447583
MEEDLFQLRQLPVVKFRRTGESARSEDDTASGEHEVQIEGVHVGLEAVELDDGAAVPKEFANPTDGGLCRHDVQLHALGKYLRPVRQENRAEDQRAVDSVLWHP

SEQ ID NO: 36824 - protein, 155 aa, Homo sapiens
  ENSP00000447275
MEEDLFQLRQLPVVKFRRTGESARSEDDTASGEHEVQIEGVHVGLEAVELDDGAAVPKEFANPTDDTFMVEDAVEAIGFGKFQWKLSVLTGLAWVVFVGMMSSSTLWGNISDQYGRKTGLKISVLWTLYYGILSAFAPVYSWILVLRGLVGFGIG

SEQ ID NO: 36825 - protein, 527 aa, Homo sapiens
  ENSP00000399056
MGSLKEELLKAIWHAFTALDQDHSGKVSKSQLKVLSHNLCTVLKVPHDPVALEEHFRDDDEGPVSNQGYMPYLNRFILEKIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEQLELERKQALEQYEEVKKKLEMATNKTKSWKDKVAHHEGLIRLIEPGSKNPHLITNWGPAAFTEAELEEREKNWKEKKTTE

SEQ ID NO: 36826 - protein, 585 aa, Homo sapiens
  ENSP00000315630
MGSLKEELLKAIWHAFTALDQDHSGKVSKSQLKVLSHNLCTVLKVPHDPVALEEHFRDDDEGPVSNQGYMPYLNRFILEKVQDNFDKIEFNRMCWTLCVKKNLTKNPLLITEEDAFKIWVIFNFLSEDKYPLIIVSEEIEYLLKKLTEAMGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKKRLQTQVELQARFSTELEREKLIRQQMEEQVAQKSSELEQYLQRVRELEDMYLKLQEALEDERQARQDEETVRKLQARLLEEESSKRAELEKWHLEQQQAIQTTEAEKQELENQRVLKEQALQEAMEQLEQLELERKQALEQYEEVKKKLEMATNKTKSWKDKVAHHEGLIRLIEPGSKNPHLITNWGPAAFTEAELEEREKNWKEKKTTE

SEQ ID NO: 36827 - protein, 149 aa, Homo sapiens
  ENSP00000431768
MGSLKEELLKAIWHAFTALDQDHSGKVSKSQLKVLSHNLCTVLKVPHDPVALEEHFRDDDEGPVSNQGYMPYLNRFILEKITKTLPASEPSDMLLPVLSKTTLTRLNSIGCVGPSVSKKTSQRIPCSLQKKMHLKYGLFSTFYLRTSIH

SEQ ID NO: 36828 - protein, 226 aa, Homo sapiens
  ENSP00000435587
MGGGWQQEQFEHYKINFDDSKNGLSAWELIELIGNGQFSKGMDRQTVSMAINEVFNELILDVLKQGYMMKKGHRRKNWTERWFVLKPNIISYYVSEDLKDKKGDILLDENCCVESLPDKDGKKCLFLVKCFDKTFEISASDKKKKQEWIQAIHSTIHLLKLGSPPPHKEARQRRKELRKKQLAEQEELERQMKELQAANESKQQELEAVRKKLEEAASRAAEEEKK

SEQ ID NO: 36829 - protein, 23 aa, Homo sapiens
  ENSP00000433824
  MOD_RES (1)..(1): Any amino acid
XFPVGLGQSSSFRILRGQAERVT

SEQ ID NO: 36830 - protein, 352 aa, Homo sapiens
  ENSP00000369500
MFRGLSSWLGLQQPVAGGGQPNGDAPPEQPSETVAESAEEELQQAGDQELLHQAKDFGNYLFNFASAATKKITESVAETAQTIKKSVEEGKIDGIIDKTIIGDFQKEQKKFVEEQHTKKSEAAVPPWVDTNDEETIQQQILALSADKRNFLRDPPAGVQFNFDFDQMYPVALVMLQEDELLSKMRFALVPKLVKEEVFWRNYFYRVSLIKQSAQLTALAAQQQAAGKEEKSNGREQDLPLAEAVRPKTPPVVIKSQLKTQEDEEEISTSPGVSEFVSDAFDACNLNQEDLRKEMEQLVLDKKQEETAVLEEDSADWEKELQQELQEYEVVTESEKRDENWDKEIEKMLQEEN

SEQ ID NO: 36831 - protein, 976 aa, Homo sapiens
  ENSP00000358535
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 36832 - protein, 792 aa, Homo sapiens
  ENSP00000410011
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKK

SEQ ID NO: 36833 - protein, 976 aa, Homo sapiens; identical to SEQ ID NO: 36831
  ENSP00000358531

SEQ ID NO: 36834 - protein, 976 aa, Homo sapiens; identical to SEQ ID NO: 36831
  ENSP00000480997

SEQ ID NO: 36835 - protein, 951 aa, Homo sapiens
  ENSP00000482532
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 36836 - protein, 580 aa, Homo sapiens
  ENSP00000351614
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQAEFSELNLAAYVTGGCMVDMQVVRNGTKVVSRSFKPDFILVRQHAYSMALGEDYRSLVIGLQYGGLPAVNSLYSVYNFCSKPWVFSQLIKIFHSLGPEKFPLVEQTFFPNHKPMVTAPHFPVVVKLGHAHAGMGKIKVENQLDFQDITSVVAMAKTYATTEAFIDSKYDIRIQKIGSNYKAYMRTSISGNWKANTGSAMLEQVAMTERYRLWVDSCSEMFGGLDICAVKAVHSKDGRDYIIEVMDSSMPLIGEHVEEDRQLMADLVVSKMSQLPMPGGTAPSPLRPWAPQIKSAKSPGQAQLGPQLGQPQPRPPPQGGPRQAQSPQPQRSGSPSQQRLSPQGQQPLSPQSGSPQQQRSPGSPQLSRASSGSSPNQASKPGATLASQPRPPVQGRSTSQQGEESKKPAPPHPHLNKSQSLTNSLSTSDTSQRGTPSEDEAKAETIRNLRKSFASLFSD

SEQ ID NO: 36837 - protein, 123 aa, Homo sapiens
  ENSP00000395794
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKVNGEIEIRVEQ

SEQ ID NO: 36838 - protein, 113 aa, Homo sapiens
  ENSP00000388582
MNFLRRRLSDSSFMANLPNGYMTDLQRPDSSTSSPASPAMERRHPQPLAASFSSPGSSLFSSLSSAMKQAPQATSGLMEPPGPSTPIVQRPRILLVIDDAHTDWSKYFHGKKV

SEQ ID NO: 36839 - protein, 187 aa, Homo sapiens [sequence omitted]

SEQ ID NO: 36840 - protein, 323 aa, Homo sapiens [sequence omitted]

SEQ ID NO: 36841 - protein, 258 aa, Homo sapiens
  ENSP00000366058
MDGIIEQKSMLVHSKISDAGKRNGLINTRNLMAESRDGLVSVYPAPQYQSHRVGASTVPASLDSSRSEPMQQLLDPNTLQQSVESRYRPNIILYSEGVLRSWGDGVAADCCETTFIEDRSPTKDSLEYPDGKFIDLSADDIKIHTLSYDVEEEEEFQELESDYSSDTESEDNFLMMPPRDHLGLSVFSMLCCFWPLGIAAFYLSHETNKAVAKGDLHQASTSSRRALFLAVLSITIGTGVYVGVAVALIAYLSKNNHL

SEQ ID NO: 36842 - protein, 238 aa, Homo sapiens
  ENSP00000450439
MESLSELQNPLLPRSPAHLHGPYPYPETPPSWSCQEKLYSYLLGGAGPAGAHQLLDPGSLQLAVEAWYRPSCLLGRDKVKEPRAGSCETSFTEDREPQEGPPEQPTGPGQAAENVTIQTVSYGVQEELRDQEDDQEEEESDATSTESESEDNFLTLPPRDHLGLTLFSMLCCFWPLGIAAFYFSQGTSKAISKGDFRLASTTSRRALFLATLAIAVGAGLYVAVVVALAAYMSQNGHG

SEQ ID NO: 36843 - protein, 80 aa, Homo sapiens
  ENSP00000451519
MESLSELQNPLLPRSPAHLHGPYPYPETPPSWSCQEKLYSYLLGGAGPAGAHQLLDPGSLQLAVEAWYRPSCLLGRDKVK

SEQ ID NO: 36844 - protein, 238 aa, Homo sapiens; identical to SEQ ID NO: 36842
  ENSP00000331474

SEQ ID NO: 36845 - protein, 1496 aa, Homo sapiens
  ENSP00000347792
MALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 36846 - protein, 1288 aa, Homo sapiens
  ENSP00000492532
MALSKGLRLLGRLGAEGDCSVLLEARGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKIVFCSRSQASQPCLLLQRHEFVRTVAAQRLASVDTSGSSV

SEQ ID NO: 36847 - protein, 136 aa, Homo sapiens
  ENSP00000356080
  MOD_RES (1)..(1): Any amino acid
XGRDDCLLFEAGTVATLAPEEKEVIKGQYGKLTDAYGCLGELRLKSGGTSLSFLVLVTGCTSVGRIPDAEIYKITATDFYPLQEEAKEEERLIALKKILSSGVFYFSWPNDGSRFDLTVRTQKQGDDSSEWGNSFF

SEQ ID NO: 36848 - protein, 1259 aa, Homo sapiens
  ENSP00000492369
MIYMDDGVSSFVQIRGSVPLFWEQPGLQVGSHHLRLHRGLEANAPAFDRHMVLLKEQYGQQVVVNLLGSRGGEEVLNRAFKKLLWASCHAGDTPMINFDFHQFAKGGKLEKLETLLRPQLKLHWEDFDVFTKGENVSPRFQKGTLRMNCLDCLDRTNTVQSFIALEVLHLQLKTLGLSSKPIVDRFVESFKAMWSLNGHSLSKVFTGSRALEGKAKVGKLKDGARSMSRTIQSNFFDGVKQEAIKLLLVGDVYGEEVADKGGMLLDSTALLVTPRILKAMTERQSEFTNFKRIRIAMGTWNVNGGKQFRSNVLRTAELTDWLLDSPQLSGATDSQDDSSPADIFAVGFEEMVELSAGNIVNASTTNKKMWGEQLQKAISRSHRYILLTSAQLVGVCLYIFVRPYHVPFIRDVAIDTVKTGMGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 36849 - protein, 136 aa, Homo sapiens
  ENSP00000411202
MFLYASGPAPPAGTCRWGGQGGTSLSFLVLVTGCTSVGRIPDAEIYKITATDFYPLQEEAKEEERLIALKKILSSGVFYFSWPNDGSRFDLTVRTQKQGDDSSEWGNSFFWNQLLHVPLRQHQVSCCDWLLKIICG

SEQ ID NO: 36850 - protein, 165 aa, Homo sapiens
  ENSP00000436657
  MOD_RES (1)..(1): Any amino acid
XVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRHMVLLKEQYGQQVVVNLLGSRGGEEVLNRAFKVRPGCPLHSWAGRQVAMVER

SEQ ID NO: 36851 - protein, 839 aa, Homo sapiens
  ENSP00000356089
MGGKAGNKGAVGIRFQFHSTSFCFICSHLTAGQSQVKERNEDYKEITQKLCFPMGRNVFSHDYVFWCGDFNYRIDLTYEEVFYFVKRQDWKKLLEFDQLQLQKSSGKIFKDFHEGAINFGPTYKYDVGSAAYDTSDKCRTPAWTDRVLWWRKKHPFDKTAGELNLLDSDLDVDTKVRHTWSPGALQYYGRAELQASDHRPVLAIVEVEVQEVDVGARERVFQEVSSFQGPLDATVVVNLQSPTLEEKNEFPEDLRTELMQTLGSYGTIVLVRINQGQMLVTFADSHSALSVLDVDGMKVKGRAVKIRPKTKDWLKGLREEIIRKRDSMAPVSPTANSCLLEENFDFTSLDYESEGDILEDDEDYLVDEFNQPGVSDSELGGDDLSDVPGPTALAPPSKSPALTKKKQHPTYKDDADLVELKRELEAVGEFRHRSPSRSLSVPNRPRPPQPPQRPPPPTGLMVKKSASDASISSGTHGQYSILQTARLLPGAPQQPPKARTGISKPYNVKQIKTTNAQEAEAAIRCLLEARGGASEEALSAVAPRDLEASSEPEPTPGAAKPETPQAPPLLPRRPPPRVPAIKKPTLRRTGKPLSPEEQFEQQTVHFTIGPPETSVEAPPVVTAPRVPPVPKPRTFQPGKAAERPSHRKPASDEAPPGAGASVPPPLEAPPLVPKVPPRRKKSAPAAFHLQVLQSNSQLLQGLTYNSSDSPSGHPPAAGTVFPQGDFLSTSSATSPDSDGTKAMKPEAAPLLGDYQDPFWNLLHHPKLLNNTWLSKSSDPLDSGTRSPKRDPIDPVSAGASAAKAELPPDHEHKTLGHWVTISDQEKRTALQVFDPLAKT

SEQ ID NO: 36852 - protein, 285 aa, Homo sapiens
  ENSP00000418994
MDPVSQLASAGTFRVLKEPLAFLRALELLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 36853 - protein, 34 aa, Homo sapiens
  ENSP00000402121
MDPVSQLASAGTFRVLKEPLAFLRALELVAPGDV

SEQ ID NO: 36854 - protein, 75 aa, Homo sapiens
  ENSP00000419441
MDPVSQLASAGTFRVLKEPLAFLRALELLFAIFAFATCGGYSGGLRLSVDCVNKTESNLSIDIAFAYPFRTSLSL

SEQ ID NO: 36855 - protein, 265 aa, Homo sapiens
  ENSP00000295894
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 36856 - protein, 55 aa, Homo sapiens
  ENSP00000420383
MCMVIFAPLFAIFAFATCGGYSGGLRLSVDCVNKTESNLSIDIAFAYPFRTSLSL

SEQ ID NO: 36857 - protein, 51 aa, Homo sapiens
  ENSP00000420623
MCMVIFAPKGFLKRFFSGSLQKAFCNLCICNMRWLFWRPAAECGLRQQDRK

SEQ ID NO: 36858 - protein, 202 aa, Homo sapiens
  ENSP00000418929
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVLSEIQSAKALKKRERVATLTGL

SEQ ID NO: 36859 - protein, 276 aa, Homo sapiens
  ENSP00000418701
MCMVIFAPHNEECKSHFHLLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 36860 - protein, 201 aa, Homo sapiens
  ENSP00000418123
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 36861 - protein, 523 aa, Homo sapiens
  ENSP00000228567
MSFHKEDGVNSLCQKALHIVTELCFAGQVEWEKCSGIFPRDRGSQGGSSTDISVSLLAVVVSFCGLALLVVSLFVFWKLCWPCWKSKPVTSNITTLPQSISSAPTEVFETEEKKEIKENEKPAVKAIEPAIKISHTSPDIPAEVQTALKEHLIKHARVQRQITEPTSSTRHSSFRRHLPRQMQVSSVDFSMGTEPVLQRGETTTSIGRIKPELYKQKSVDSEGNQNEDVKICGKLNFTLQYDYENELLVVKIIKALDLPAKDFTGTSDPYVKMYLLPDRKKKFQTRVHRKTLNPLFDETFQFPVAYDQLSNRKLHFSVYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLSIAVMDYDRVGHNEVIGVCRTGLDAEGLGRDHWNEMLAYHRKPITHWHPLLELPGRATSFDSQGSCPSPKPPSTP

SEQ ID NO: 36862 - protein, 194 aa, Homo sapiens
  ENSP00000444577
MSFHKEDGVNSLCQKALHIVTELCFAGQVEWEKCSGIFPRDRGSQGGSSTDISVSLLAVVVSFCGLALLVVSLFVFWKLCWPCWKSKPVTSNITTLPQSISSAPTEVFETEEKKEIKENEKPAVKAIEPAIKISHTSPDIPAEVQTALKEHLIKHARVQRQITEPTSSTRGWGKKKKKRILSTCNFVTMPRHPS

SEQ ID NO: 36863 - protein, 421 aa, Homo sapiens
  ENSP00000377520
MAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSLSIEDTFESISELGPLELMGRELDLAPYGTLRKSQSADSLNSISSVSNTFGQDFTLGQVEVSMEYDTASHTLNVAVMQGKDLLEREEASFESCFMRVSLLPDEQIVGISRIQRNAYSIFFDEKFSIPLDPTALEEKSLRFSVFGIDEDERNVSTGVVELKLSVLDLPLQPFSGWLYLQDQNKAADAVGEILLSLSYLPTAERLTVVVVKAKNLIWTNDKTTADPFVKVYLLQDGRKMSKKKTAVKRDDPNPVFNEAMIFSVPAIVLQDLSLRVTVAESSSDGRGDNVGHVIIGPSASGMGTTHWNQMLATLRRPVSMWHAVRRN

SEQ ID NO: 36864 - protein, 421 aa, Homo sapiens; identical to SEQ ID NO: 36863
  ENSP00000431400

SEQ ID NO: 36865 - protein, 421 aa, Homo sapiens; identical to SEQ ID NO: 36863
  ENSP00000435316

SEQ ID NO: 36866 - protein, 98 aa, Homo sapiens
  ENSP00000434709
MAVDVAEYHLSVIKSPPGWEVGVYAAGALALLGIAAVSLWKLWTSGSFPSPSPFPNYDYRYLQQKYGESCAEAREKRVPAWNAQRASTRGPPSRKGSL

SEQ ID NO: 36867 - protein, 574 aa, Homo sapiens
  ENSP00000355986
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 36868 - protein, 864 aa, Homo sapiens
  ENSP00000489897
MAFFRNFQQNLPSVSSLVDTISSAVEDLTTAVGEVSYALTDSVAEQVTSMMSGFRPEEESSVAEEAVDTSKQKNAGLTEVSKNTNCQKTQANLEHRAKQINTCKTSLKQDQGIHEERVFKHVNDRQQTLSEYQDTGNTGDSSLKGYMNNGGISVIRQNTRAGSICQELESTDRCKTIGVGISNNGKNDLKEVGYQEMKGNQKNANGINKLYEQKKYVGTDNCKKEEYSKSRHVYLGRDQENMGHFNKCKHLPDLGHSDHLKKAEKCVKSKASKGNECSGNECSLKDILTSNRHMTQKSIIKEDIHPAPSTNSKDKLSGKIEEQINSTKYCKVNEDIKPKKTEAISAKKGTAKSKDEKYSKIIPEKDNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 36869 - protein, 86 aa, Homo sapiens
  ENSP00000489671
MAIEGGERTCGVHELICIRKDRVFLCGQAGVQWHHLGSLQLPPPGFKRFFCLSIPSNWDYSISRGSWIFVSCWGVYYLDAAPFSLY

SEQ ID NO: 36870 - protein, 555 aa, Homo sapiens
  ENSP00000418901
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 36871 - protein, 265 aa, Homo sapiens
  ENSP00000445837
MLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWAVTPK

SEQ ID NO: 36872 - protein, 517 aa, Homo sapiens
  ENSP00000355982
MLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 36873 - protein, 504 aa, Homo sapiens
  ENSP00000442891
  MOD_RES (1)..(1): Any amino acid
XYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPTFHPLLSDGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 36874 - protein, 619 aa, Homo sapiens
  ENSP00000486230
MASASWRLKVEREPVEYMNLSVLEKIGYFSVARLEYSGTILAHCNFRLLGSNDSSASASQVTGTTVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNGLFCCLKHLIGGQVYIIRDTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 36875 - protein, 517 aa, Homo sapiens; identical to SEQ ID NO: 36872
  ENSP00000437423

SEQ ID NO: 36876 - protein, 221 aa, Homo sapiens
  ENSP00000490266
MATDITPEAIGFLSAVGVFIVLLAVLFLFINKKLCFETIGGLPFLEHRGKRKHSKDKTGIHKGLVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPE

SEQ ID NO: 36877 - protein, 645 aa, Homo sapiens
  ENSP00000478637
MVLAMASQDVQNFFQPFSSWISRVYEALQQAGDMLSASLVNISKQDSKLSDKLDQDLDNIQIQETYFEDEEQDNDWSQEDANSLFLEVDHFSCCNSDLQDSAQNSSPSLSQHAKDSCSTMSQWPNWASDDRKLPHVLSSIAEEEHHLEKQRSGLQHGFDSQLPGTLETVNGKKQVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPEEQDRTNLQVPSGVSEPISKCGDLDVIFEYRAASQKLTVTIVRAQGLPDKDRSGVNSWQVHVVLLPGKKHRGRTNIQRGPNPVFREKVTFAKLEPRDVAACAVRFRLYAARKMTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 36878 - protein, 383 aa, Homo sapiens
  ENSP00000451035
MVLAMASQDVQNFFQPFSSWISRVYEALQQAGDMLSASLVNISKQDSKLSDKLDQDLDNIQIQETYFEDEEQDNDWSQEDANSLFLEVDHFSCCNSDLQDSAQNSSPSLSQHAKDSCSTMSQWPNWASDDRKLPHVLSSIAEEEHHLEKQRSGLQHGFDSQLPGTLETVNGKKQVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPEANLNLKRKGYLLDVYCLSSPLLFTTSLHRRNRTGPICRCHPGSQSPSQSVVT

SEQ ID NO: 36879 - protein, 203 aa, Homo sapiens
  ENSP00000394700
MTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 36880 - protein, 79 aa, Homo sapiens
  ENSP00000456790
MASRSSDKDGDSVHTASEVPLTPRTNSPDGRRSSSDTSKSTYSLTRRISSLESRRPSSPLIDIKPIEFGVLSAKKEPIQ

SEQ ID NO: 36881 - protein, 93 aa, Homo sapiens
  ENSP00000454335
MASRSSDKDGDSVHTASEVPLTPRTNSPDGRRSSSDTSKSTYSLTRRISSLESRRPSSPLIDIKPIEFGVLSAKKEPIQPSVLRRTYNPDDYF

SEQ ID NO: 36882 - protein, 474 aa, Homo sapiens
  ENSP00000347538
MAYIQLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 36883 - protein, 392 aa, Homo sapiens
  ENSP00000456009
MASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTGSNSPIPACELSSHPAHGISPWIPSPGNEHFHGIKKQVKAIKVE

SEQ ID NO: 36884 - protein, 413 aa, Homo sapiens
  ENSP00000456252
MASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 36885 - protein, 470 aa, Homo sapiens
  ENSP00000454721
MLEPLNEGFLSRISGLLLCRWTCRHCCQKCYESSCCQSSEDEVEILGPFPAQTPPWLMASRSSDKDGDSVHTASEVPLTPRTNSPDGRRSSSDTSKSTYSLTRRISSLESRRPSSPLIDIKPIEFGVLSAKKEPIQPSVLRRTYNPDDYFRKFEPHLYSLDSNSDDVDSLTDEEILSKYQLGMLHFSTQYDLLHNHLTVRVIEARDLPPPISHDGSRQDMAHSNPYVKICLLPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 36886 - protein, 142 aa, Homo sapiens
  ENSP00000456879
  MOD_RES (1)..(1): Any amino acid
XPDQKNSKQTGVKRKTQKPVFEERYTFEIPFLEAQRRTLLLTVVDFDKFSRHCVIGKVSVPLCEVDLVKGGHWWKALIPSSQNEVELGELLLSLNYLPSAGRLNVDVIRAKQLLQTDVSQGSAGAWTQTCENQEDVLLKGHN

SEQ ID NO: 36887 - protein, 168 aa, Homo sapiens
  ENSP00000456915
MGTFFAFMEKKNEVELGELLLSLNYLPSAGRLNVDVIRAKQLLQTDVSQGSDPFVKIQLVHGLKLVKTKKTSFLRGTIDPFYNESFSFKVPQEELENASLVFTVFGHNMKSSNDFIGRIVIGQYSSGPSETNHWRRMLNTHRTAVEQWHSLRSRAECDRVSPASLEVT

SEQ ID NO: 36888 - protein, 419 aa, Homo sapiens
  ENSP00000356236
MRNIFKRNQEPIVAPATTTATMPIGPVDNSTESGGAGESQEDMFAKLKEKLFNEINKIPLPPWALIAIAVVAGLLLLTCCFCICKKCCCKKKKNKKEKGKGMKNAMNMKDMKGGQDDDDAETGLTEGEGEGEEEKEPENLGKLQFSLDYDFQANQLTVGVLQAAELPALDMGGTSDPYVKVFLLPDKKKKYETKVHRKTLNPAFNETFTFKVPYQELGGKTLVMAIYDFDRFSKHDIIGEVKVPMNTVDLGQPIEEWRDLQGGEKEEPEKLGDICTSLRYVPTAGKLTVCILEAKNLKKMDVGGLSDPYVKIHLMQNGKRLKKKKTTVKKKTLNPYFNESFSFEIPFEQIQKVQVVVTVLDYDKLGKNEAIGKIFVGSNATGTELRHWSDMLANPRRPIAQWHSLKPEEEVDALLGKNK

SEQ ID NO: 36889 - protein, 419 aa, Homo sapiens; identical to SEQ ID NO: 36888
  ENSP00000356237

SEQ ID NO: 36890 - protein, 79 aa, Homo sapiens
  ENSP00000469834
GHNEVIGVCRVGPDAADPHGREHWAEMLANPRKPVEHWHQLVEVSRGPTPTPDKHPCTLGPFIHATNALHVRESQSQAS

SEQ ID NO: 36891 - protein, 590 aa, Homo sapiens
  ENSP00000340914
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 36892 - protein, 590 aa, Homo sapiens; identical to SEQ ID NO: 36891
  ENSP00000469398

SEQ ID NO: 36893 - protein, 590 aa, Homo sapiens; identical to SEQ ID NO: 36891
  ENSP00000468982

SEQ ID NO: 36894 - protein, 96 aa, Homo sapiens
  ENSP00000469637
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPL

SEQ ID NO: 36895 - protein, 425 aa, Homo sapiens
  ENSP00000255224
MAPITTSREEFDEIPTVVGIFSAFGLVFTVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 36896 - protein, 407 aa, Homo sapiens
  ENSP00000466930
MAPITTSREEFVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 36897 - protein, 103 aa, Homo sapiens
  ENSP00000470516
MLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVE

SEQ ID NO: 36898 - protein, 143 aa, Homo sapiens
  ENSP00000472583
MKSPQWWGSSVHLAWSSQSLSLHGSAVRENHPMKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPK

SEQ ID NO: 36899 - protein, 403 aa, Homo sapiens
  ENSP00000263846
MYRDPEAASPGAPSRDVLLVSAIITVSLSVTVVLCGLCHWCQRKLGKRYKNSLETVGTPDSGRGRSEKKAIKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 36900 - protein, 478 aa, Homo sapiens
  ENSP00000444201
MYRDPEAASPGAPSRDVLLVSAIITVSLSVTVVLCGLCHWCQRKLGKRYKNSLETVGTPDSGRGRSEKKAINGTLLSGAKVAAAAGLAVEREGRLGEKPAPVPPPGEDALRSGGAAPSEPGSGGKAGRGRWRTVQSHLAAGKLNLSKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 36901 - protein, 122 aa, Homo sapiens
  ENSP00000438171
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNPLFLRR

SEQ ID NO: 36902 - protein, 122 aa, Homo sapiens; identical to SEQ ID NO: 36901
  ENSP00000441184

SEQ ID NO: 36903 - protein, 686 aa, Homo sapiens
  ENSP00000439694
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNGTLLSGAKVAAAAGLAVEREGRLGEKPAPVPPPGEDALRSGGAAPSEPGSGGKAGRGRWRTVQSHLAAGKLNLSNFEDSTLSTATTLESIPSSTGEPKCQRPRTLMRQQSLQQPLSQHQRGRQPSQPTTSQSLGQLQAHMASAPGPNPRAYGRGQARQGTSAGSKYRAAGGRSRSNPGSWDHVVGQIRNRGLDMKSFLEGRMVVLSLVLGLSEQDDFANIPDLQNPGTQQNQNAQGDKRLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 36904 - protein, 447 aa, Homo sapiens
  ENSP00000444568
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 36905 - protein, 611 aa, Homo sapiens
  ENSP00000444019
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNFEDSTLSTATTLESIPSSTGEPKCQRPRTLMRQQSLQQPLSQHQRGRQPSQPTTSQSLGQLQAHMASAPGPNPRAYGRGQARQGTSAGSKYRAAGGRSRSNPGSWDHVVGQIRNRGLDMKSFLEGRMVVLSLVLGLSEQDDFANIPDLQNPGTQQNQNAQGDKRLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 36906 - protein, 522 aa, Homo sapiens
  ENSP00000437720
MYRDPEAASPGAPSRDVLLVSAIITVSLSVTVVLCGLCHWCQRKLGKRYKNSLETVGTPDSGRGRSEKKAINDLDRDFWNNNESTVQQKWSSYPPKEFILNISPYAPYGDPRLSLNGTLLSGAKVAAAAGLAVEREGRLGEKPAPVPPPGEDALRSGGAAPSEPGSGGKAGRGRWRTVQSHLAAGKLNLSKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 36907 - protein, 175 aa, Homo sapiens
  ENSP00000443576
MYRDPEAASPGAPSRDVLLVSAIITVSLSVTVVLCGLCHWCQRKLGKRYKNSLETVGTPDSGRGRSEKKAIKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFV

SEQ ID NO: 36908 - protein, 1861 aa, Homo sapiens
  ENSP00000263635
MLKAVLKKSREGGKGGKKEAGSDFGPETSPVLHLDHSADSPVSSLPTAEDTYRVSLAKGVSMSLPSSPLLPRQSHLVQSRVNKKSPGPVRKPKYVESPRVPGDAVIMPFREVAKPTEPDEHEAKADNEPSCSPAAQELLTRLGFLLGEGIPSATHITIEDKNETMCTALSQGISPCSTLTSSTASPSTDSPCSTLNSCVSKTAANKSPCETISSPSSTLESKDSGIIATITSSSENDDRSGSSLEWNKDGNLRLGVQKGVLHDRRADNCSPVAEEETTGSAESTLPKAESSAGDGPVPYSQGSSSLIMPRPNSVAATSSTKLEDLSYLDGQRNAPLRTSIRLPWHNTAGGRAQEVKARFAPYKPQDILLKPLLFEVPSITTDSVFVGRDWLFHQIEENLRNTELAENRGAVVVGNVGFGKTAIISKLVALSCHGSRMRQIASNSPGSSPKTSDPTQDLHFTPLLSPSSSTSASSTAKTPLGSISAENQRPREDAVKYLASKVVAYHYCQADNTYTCLVPEFVHSIAALLCRSHQLAAYRDLLIKEPQLQSMLSLRSCVQDPVAAFKRGVLEPLTNLRNEQKIPEEEYIILIDGLNEAEFHKPDYGDTLSSFITKIISKFPAWLKLIVTVRANFQEIISALPFVKLSLDDFPDNKDIHSDLHAYVQHRVHSSQDILSNISLNGKADATLIGKVSSHLVLRSLGSYLYLKLTLDLFQRGHLVIKSASYKVVPVSLSELYLLQCNMKFMTQSAFERALPILNVALASLHPMTDEQIFQAINAGHIQGEQGWEDFQQRMDALSCFLIKRRDKTRMFCHPSFREWLVWRADGENTAFLCEPRNGHALLAFMFSRQEGKLNRQQTMELGHHILKAHIFKGLSKKTGISSSHLQALWIGYSTEGLSAALASLRNLYTPNVKVSRLLILGGANVNYRTEVLNNAPILCVQSHLGHEEVVTLLLEFGACLDGTSENGMTALCYAAAAGHMKLVCLLTKKGVRVDHLDKKGQCALVHSALRGHGDILQYLLTCEWSPGPPQPGTLRKSHALQQALTAAASMGHSSVVQCLLGMEKEHEVEVNGTDTLWGETALTAAAGRGKLEVCELLLGHGAAVSRTNRRGVPPLFCAARQGHWQIVRLLLERGCDVNLSDKQGRTPLMVAACEGHLSTVEFLLSKGAALSSLDKEGLSALSWACLKGHRAVVQYLVEEGAAIDQTDKNGRTPLDLAAFYGDAETVLYLVEKGAVIEHVDHSGMRPLDRAIGCRNTSVVVALLRKGAKLGNAAWAMATSKPDILIILLQKLMEEGNVMYKKGKMKEAAQRYQYALRKFPREGFGEDMRPFNELRVSLYLNLSRCRRKTNDFGMAEEFASKALELKPKSYEAFYARARAKRNSRQFVAALADLQEAVKLCPTNQEVKRLLARVEEECKQLQRSQQQKQQGPLPAPLNDSENEEDTPTPGLSDHFHSEETEEEETSPQEESVSPTPRSQPSSSVPSSYIRNLQEGLQSKGRPVSPQSRAGIGKSLREPVAQPGLLLQPSKQAQIVKTSQHLGSGQSAVRNGSMKVQISSQNPPPSPMPGRIAATPAGSRTQHLEGTGTFTTRAGCGHFGDRLGPSQNVRLQCGENGPAHPLPSKTKTTERLLSHSSVAVDAAPPNQGGLATCSDVRHPASLTSSGSSGSPSSSIKMSSSTSSLTSSSSFSDGFKVQGPDTRIKDKVVTHVQSGTAEHRPRNTPFMGIMDKTARFQQQSNPPSRSWHCPAPEGLLTNTSSAAGLQSANTEKPSLMQVGGYNNQAKTCSVSTLSASVHNGAQVKELEESKCQIPVHSQENRITKTVSHLYQESISKQQPHISNEAHRSHLTAAKPKRSFIESNV

SEQ ID NO: 36909 - protein, 1235 aa, Homo sapiens
  ENSP00000310094
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 36910 - protein, 1122 aa, Homo sapiens
  ENSP00000440336
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 36911 - protein, 1049 aa, Homo sapiens
  ENSP00000279394
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKSKELQIKKQFQETCKIQTRQYKALRAHLLETTPKAQHKSLLKRLKEEQTRKLAILAEQYDQSISEMLSSQALRLDETQEAEFQALRQQLQQELELLNAYQSKIKIRTESQHERELRELEQRVALRRALLEQRVEEELLALQTGRSERIRSLLERQAREIEAFDAESMRLGFSSMALGGIPAEAAAQGYPAPPPAPAWPSRPVPRSGAHWSHGPPPPGMPPPAWRQPSLLAPPGPPNWLGPPTQSGTPRGGALLLLRNSPQPLRRAASGGSGSENVGPPAAAVPGPLSRSTSVASHILNGSSHFYS

SEQ ID NO: 36912 - protein, 1062 aa, Homo sapiens
  ENSP00000393048
MMGTSQGHVARKSRNWGLNPSRLSSIPLSSTPCHLSPSSLSPFSVAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 36913 - protein, 898 aa, Homo sapiens
  ENSP00000416374
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLIDLIQRTKDAVRELDNLQYRKMKKILFQETRNGPLNESQEDEEDSEHGTSLNREMDSLGSNHSIPSMSVSTGSQSSSVNSMQEVMDESSSELVMMHDDESTINSSSSVVHKKDHVFIRDEAGHGDPRPEPRPTQSVQSQALHYRNRERFATIKSASLVTRQIHEHEQENELREQMSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 36914 - protein, 898 aa, Homo sapiens; identical to SEQ ID NO: 36913
  ENSP00000376317

SEQ ID NO: 36915 - protein, 93 aa, Homo sapiens
  ENSP00000441932
MELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 36916 - protein, 438 aa, Homo sapiens
  ENSP00000443834
MSGYKRMRRQHQKQLIALENKLKAEMDEHRLKLQKEVETHANNSSIELEKLAKKQVAIIEKEAKVAAADEKKFQQQILAQQKKDLTTFLESQKKQYKICKEKIKEEMNEDHSTPKKEKQERISKHKENLQHTQAEEEAHLLTQQRLYYDKNCRFFKRKIMIKRHEVEQQNIREELNKKRTQKEMEHAMLIRHDESTRELEYRQLHTLQKLRMDLIRLQHQTELENQLEYNKRRERELHRKHVMELRQQPKNLKAMEMQIKKQFQDTCKVQTKQYKALKNHQLEVTPKNEHKTILKTLKDEQTRKLAILAEQYEQSINEMMASQALRLDEAQEAECQALRLQLQQEMELLNAYQSKIKMQTEAQHERELQKLEQRVSLRRAHLEQKIEEELAALQKERSERIKNLLERQEREIETFDMESLRMGFGNLVTLDFPKEDYR

SEQ ID NO: 36917 - protein, 38 aa, Homo sapiens
  ENSP00000443487
MSGYKRMRRQHQKQLIALENKLKAEMDEHRLKLQKEVE

SEQ ID NO: 36918 - protein, 14 aa, Homo sapiens
  ENSP00000439620
MSGYKRMRRQHQKQ

SEQ ID NO: 36919 - protein, 185 aa, Homo sapiens
  ENSP00000437389
QRLLLERTHCLVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVDYCLQKIPQERPTSAELLRHDFVRRDRPLRVLI

SEQ ID NO: 36920 - protein, 136 aa, Homo sapiens
  ENSP00000443465
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLA

SEQ ID NO: 36921 - protein, 93 aa, Homo sapiens
  ENSP00000438820
MRKGVLKDPEIADLFYKDDPEELFIGLHEIGHGSFGAVYFATNAHTSEVVAIKKMSYSGKQTHEKWQDILKEVKFLRQLKHPNTIEYKGCYLK

SEQ ID NO: 36922 - protein, 61 aa, Homo sapiens
  ENSP00000444057
MRKGVLKDPEIADLFYKDDPEELFIGLHEIGHGSFGAVYFATNAHTSEVVAIKKMSYSGKQ

SEQ ID NO: 36923 - protein, 57 aa, Homo sapiens
  ENSP00000440315
MRKGVLKDPEIADLFYKDDPEELFIGLHEIGHGSFGAVYFATNAHTSEVVAIKKMSY

SEQ ID NO: 36924 - protein, 36 aa, Homo sapiens
  ENSP00000441071
MRKGVLKDPEIADLFYKDDPEELFIGLHEIGHGSFG

SEQ ID NO: 36925 - protein, 21 aa, Homo sapiens
  ENSP00000442541
MRKGVLKDPEIADLFYKDDPE

SEQ ID NO: 36926 - protein, 18 aa, Homo sapiens
  ENSP00000438766
MRKGVLKDPEIADLFYKD

SEQ ID NO: 36927 - protein, 1159 aa, Homo sapiens
  ENSP00000423651
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKSISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 36928 - protein, 1168 aa, Homo sapiens
  ENSP00000261439
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 36929 - protein, 144 aa, Homo sapiens
  ENSP00000383994
MEPITFTARKHLLSNEVSVDFGLQLVGSLPVHSLTTMPMLPWVVAEVRRLSRQSTRKEPVTKQVRLCVSPSGLRCEPEPGRSQQWDPLIYSSIFECKPQRVHKLIHNSHDPSYFACLIKEDAVHRQSICYVFKADDQTKCSSSL

SEQ ID NO: 36930 - protein, 599 aa, Homo sapiens
  ENSP00000396877
MSPLFSWVAKVPEIISSIRQAGKIARQEELHCPSEFDDTFSKKFEVLFCGRVTVAHKKAPPALIDECIEKFNHVSGSRGSESPRPNPPHAAPTGSQEPVRRPMRKSFSQPGLRSLAFRKELQDGGLRSSGFFSSFEESDIENHLISGHNIVQPTDIEENRTMLFTIGQSEVYLISPDTKKIALEKNFKEISFCSQGIRHVDHFGFICRESSGGGGFHFVCYVFQCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEDYSELGELPPRSPLEPVCEDGPFGPPPEEKKRTSRELRELWQKAI

SEQ ID NO: 36931 - protein, 856 aa, Homo sapiens
  ENSP00000421641
  MOD_RES (1)..(1): Any amino acid
XCTNEALVDEIMMTLKQAFTVAAVQQTAKAPAQLCEGCPLQSLHKLCERIEGMNSSKTKLELQKHLTTLTNQEQATIFEEVQKLRPRNEQRENELIISFLRCLYEEKQKEHIHIGEMKQTSQMAAENIGSELPPSATRFRLDMLKNKAKRSLTESLESILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNISYRNALRKKLHSSSSVPNFLKFLAPVDENNTSDFMNTKRDFESKANHLGDSGGTPVKTRRHSWRQQIFLRVATPQKACDSSSRYEDYSELGELPPRSPLEPVCEDGPFGPPPEEKKRTSRELRELWQKAILQQILLLRMEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 36932 - protein, 177 aa, Homo sapiens
  ENSP00000425655
  MOD_RES (1)..(1): Any amino acid
XMNSSKTKLELQKHLTTLTNQEQATIFEEVQKLRPRNEQRENELIISFLRCLYEEKQKEHIHIGEMKQEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGT

SEQ ID NO: 36933 - protein, 252 aa, Homo sapiens
  ENSP00000397640
  MOD_RES (1)..(1): Any amino acid
XSILSRGNKARGLQEHSISVDLDSSLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERNVDPSPVGESKHRPGQSSAPAPPPRLNPSASSPNFFKYLKHNSSGEQSGNAVPKRDFESKANHLGDSGGTPVKTRRHSWRQQIFLRVATPQKACDSSSRYEDYSELGELPPRSPLEPVCEDGPF

SEQ ID NO: 36934 - protein, 226 aa, Homo sapiens
  ENSP00000410167
SLSSTLSNTSKEPSVCEKEALPISESSFKLLGSSEDLSSDSESHLPEEPAPLSPQQAFRRRANTLSHFPIECQEPPQPARGSPGVSQRKLMRYHSVSTETPHERKDFESKANHLGDSGGTPVKTRRHSWRQQIFLRVATPQKACDSSSRYEEPHCGSPSLACTEDYSELGELPPRSPLEPVCEDGPFGPPPEEKKRTSRELRELWQKAILQQILLLRMEKENQKLQ

SEQ ID NO: 36935 - protein, 432 aa, Homo sapiens
  ENSP00000478039
MEKENQKLQASENDLLNKRLKLDYEEITPCLKEVTTVWEKMLSTPGRSKIKFDMEKMHSAVGQGVPRHHRGEIWKFLAEQFHLKHQFPSKQQPKDVPYKELLKQLTSQQHAILIDLGRTFPTHPYFSAQLGAGQLSLYNILKAYSLLDQEVGYCQGLSFVAGILLLHMSEEEAFKMLKFLMFDMGLRKQYRPDMIILQIQMYQLSRLLHDYHRDLYNHLEEHEIGPSLYAAPWFLTMFASQFPLGFVARVFDMIFLQGTEVIFKVALSLLGSHKPLILQHENLETIVDFIKSTLPNLGLVQMEKTINQVFEMDIAKQLQAYEVEYHVLQEELIDSSPLSDNQRMDKLEKTNSSLRKQNLDLLEQLQVANGRIQSLEATIEKLLSSESKLKQAMLTLELERSALLQTVEELRRRSAEPSDREPECTQPEPTGD

SEQ ID NO: 36936 - protein, 1298 aa, Homo sapiens
  ENSP00000366863
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEIRQDTASESSDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 36937 - protein, 282 aa, Homo sapiens
  ENSP00000396932
DNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVVFLSGEDDPEKIEER

SEQ ID NO: 36938 - protein, 1235 aa, Homo sapiens
  ENSP00000366852
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 36939 - protein, 1290 aa, Homo sapiens
  ENSP00000395986
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADLEVVVPGSPGDCLPEEADGTDTHLGLPAGASQPALTSSRVCFPERILEDSGFDEQQEFRSRCSSVTGVQRRVHEGSQKSQPRRRHASAPSHVQPSDSEKNRTMLFQVGRFEINLISPDTKSVVLEKNFKDISSCSQGIKHVDHFGFICRESPEPGLSQYICYVFQCASESLVDEVMLTLKQAFSTAAALQSAKTQIKLCEACPMHSLHKLCERIEGLYPPRAKLVIQRHLSSLTDNEQADIFERVQKMKPVSDQEENELVILHLRQLCEAKQKTHVHIGEGPSTISNSTIPENATSSGRFKLDILKNKAKRSLTSSLENIFSRGANRMRGRLGSVDSFERSNSLASEKDYSPGDSPPGTPPASPPSSAWQTFPEEDSDSPQFRRRAHTFSHPPSSTKRKLNLQDGRAQGVRSPLLRQSSSEQCSNLSSVRRMYKESNSSSSLPSLHTSFSAPSFTAPSFLKSFYQNSGRLSPQYENEISDGEGRKRTSSTCSNESLSVGGTSVTPRRISWRQRIFLRVASPMNKSPSAMQQQDGLDRNELLPLSPLSPTMEEEPLVVFLSGEDDPEKIEERKKSKELRSLWRKAIHQQILLLRMEKENQKLEASRDELQSRKVKLDYEEVGACQKEVLITWDKKLLNCRAKIRCDMEDIHTLLKEGVPKSRRGEIWQFLALQYRLRHRLPNKQQPPDISYKELLKQLTAQQHAILVDLGRTFPTHPYFSVQLGPGQLSLFNLLKAYSLLDKEVGYCQGISFVAGVLLLHMSEEQAFEMLKFLMYDLGFRKQYRPDMMSLQIQMYQLSRLLHDYHRDLYNHLEENEISPSLYAAPWFLTLFASQFSLGFVARVFDIIFLQGTEVIFKVALSLLSSQETLIMECESFENIVEFLKNTLPDMNTSEMEKIITQVFEMDISKQLHAYEVEYHVLQDELQESSYSCEDSETLEKLERANSQLKRQNMDLLEKLQVAHTKIQALESNLENLLTRETKMKSLIRTLEQEKMAYQKTVEQLRKLLPADALVNCDLLLRDLNCNPNNKAKIGNKP

SEQ ID NO: 36940 - protein, 795 aa, Homo sapiens
  ENSP00000253692
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 36941 - protein, 795 aa, Homo sapiens; identical to SEQ ID NO: 36940
  ENSP00000398127

SEQ ID NO: 36942 - protein, 817 aa, Homo sapiens
  ENSP00000402935
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGDVVTGSDAQVSVPVQTLTDLQGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 36943 - protein, 593 aa, Homo sapiens
  ENSP00000411925
MLWFLSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGDVVTGSDAQVSVPVQTLTDLQGLSSKNISSSPSVESLPGGREFTGSPPSSATKKDSFFSNISRSRSHSKTMGRKESEEELEAQISFLQGQLNDLDAMCKYCAKVMDTHLGK

SEQ ID NO: 36944 - protein, 183 aa, Homo sapiens
  ENSP00000396239
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVR

SEQ ID NO: 36945 - protein, 40 aa, Homo sapiens
  ENSP00000405886
MYHSLSETRHPLQPEEQEVGIDPLSSYSNKSGGKNGKNYL

SEQ ID NO: 36946 - protein, 40 aa, Homo sapiens; identical to SEQ ID NO: 36945
  ENSP00000414250

SEQ ID NO: 36947 - protein, 142 aa, Homo sapiens
  ENSP00000387395
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPL

SEQ ID NO: 36948 - protein, 140 aa, Homo sapiens
  ENSP00000399967
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINN

SEQ ID NO: 36949 - protein, 40 aa, Homo sapiens; identical to SEQ ID NO: 36945
  ENSP00000411780

SEQ ID NO: 36950 - protein, 129 aa, Homo sapiens
  ENSP00000410596
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRK

SEQ ID NO: 36951 - protein, 110 aa, Homo sapiens
  ENSP00000393882
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIE

SEQ ID NO: 36952 - protein, 88 aa, Homo sapiens
  ENSP00000424998
MYHSLSETRHPLQPEEQEVGIDPLSSYSNKSGGDSNKNGRRTSSTLDSEGTFNSYRKEWEELFVNNNYLATIRQKGINGQLRSSRFRS

SEQ ID NO: 36953 - protein, 79 aa, Homo sapiens
  ENSP00000415379
MYHSLSETRHPLQPEEQEVGIDPLSSYSNKSGGDSNKNGRRTSSTLDSEGTFNSYRKEWEELFVNNNYLATIRQKGING

SEQ ID NO: 36954 - protein, 74 aa, Homo sapiens
  ENSP00000414159
MYHSLSETRHPLQPEEQEVGIDPLSSYSNKSGGDSNKNGRRTSSTLDSEGTFNSYRKEWEELFVNNNYLATIRQ

SEQ ID NO: 36955 - protein, 32 aa, Homo sapiens
  ENSP00000396850
MYHSLSETRHPLQPEEQEVGIDPLSSYSNKSG

SEQ ID NO: 36956 - protein, 30 aa, Homo sapiens
  ENSP00000408603
MYHSLSETRHPLQPEEQEVGIDPLSSYSNK

SEQ ID NO: 36957 - protein, 424 aa, Homo sapiens
  ENSP00000437184
MDQPSGRSFMQVLCEKYSPENFPYRRGPGMGVHVPATPQGSPMKDRLNLPSVLVLNSCGITCAGDEKEIAAFCAHVSELDLSDNKLEDWHEVSKIVSNVPQLEFLNLSSNPLNLSVLERTCAGSFSGVRKLVLNNSKASWETVHMILQELPDLEELFLCLNDYETVSCPSICCHSLKLLHITDNNLQDWTEIRKLGVMFPSLDTLVLANNHLNAIEEPDDSLARLFPNLRSISLHKSGLQSWEDIDKLNSFPKLEEVRLLGIPLLQPYTTEERRKLVIARLPSVSKLNGSVVTDGEREDSERFFIRYYVDVPQEEVPFRYHELITKYGKLEPLAEVDLRPQSSAKVEVHFNDQVEEMSIRLDQTVAELKKQLKTLVQLPTSNMLLYYFDHEAPFGPEEMKYSSRALHSFGIRDGDKIYVESKTK

SEQ ID NO: 36958 - protein, 118 aa, Homo sapiens
  ENSP00000284259
MDQPSGRSFMQVLCEKYSPENFPYRRGPGMGVHVPATPQGSPMKDRLNLPSVLVLNSCGITCAGDEKEIAAFCAHVSELDLSDNKLEDWHEKEHVLGPSLGFANLSSTTAKLLGRRST

SEQ ID NO: 36959 - protein, 83 aa, Homo sapiens
  ENSP00000431803
MDQPSGRSFMQVLCEKYSPENFPYRRGPGMGVHVPATPQGSPMKDRLNLPSVLVLNSCGITCAGDEKEIAAFCAHVSELDLSD

SEQ ID NO: 36960 - protein, 101 aa, Homo sapiens
  ENSP00000433365
MDQPSGRSFMQVLCEKYSPENFPYRRGPGMGVHVPATPQGSPMKDRLNLPSVLVLNSCGITCAGDEKEIAAFCAHVSELDLSDNKLEDWHEVCSPGKTLIN

SEQ ID NO: 36961 - protein, 424 aa, Homo sapiens; identical to SEQ ID NO: 36957
  ENSP00000403925

SEQ ID NO: 36962 - protein, 118 aa, Homo sapiens; identical to SEQ ID NO: 36958
  ENSP00000431156

SEQ ID NO: 36963 - protein, 238 aa, Homo sapiens
  ENSP00000432783
MDQPSGRSFMQVLCEKYSPENFPYRRGPGMGVHVPATPQGSPMKDRLNLPSVLVLNSCGITCAGDEKEIAAFCAHVSELDLSDNKLEDWHEVSKIVSNVPQLEFLNLSSNPLNLSVLERTCAGSFSGVRKLVLNNSKASWETVHMILQELPDLEELFLCLNDYETVSCPSICCHSLKLLHITDNNLQDWTEIRKLGVMFPSLDTLVLANNHLNAIEEPDDSLARLFPNLRSISLHKSG

SEQ ID NO: 36964 - protein, 109 aa, Homo sapiens
  ENSP00000436419
MGKKGLQSWEDIDKLNSFPKLEEVRLLGIPLLQPYTTEERRKLVIARLPSVSKLNGSVVTDGEREDSERFFIRYYVDVPQEEVPFRYHELITKYGKLEPLAEVDLRPQS

SEQ ID NO: 36965 - protein, 59 aa, Homo sapiens
  ENSP00000402923
MTELAGASSSCCHRPAGRGAMQSVLHHFQRLRGREGGSHFINTSSPRGEAKMSITSDEV

SEQ ID NO: 36966 - protein, 526 aa, Homo sapiens
  ENSP00000370348
MSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 36967 - protein, 75 aa, Homo sapiens
  ENSP00000407069
MSITSDEVNFLVYRYLQESGFSHSAFTFGIESHISQSNINGTLVPPAALISILQKGLQYVEAEISINEDGTVFDG

SEQ ID NO: 36968 - protein, 577 aa, Homo sapiens
  ENSP00000217964
MTELAGASSSCCHRPAGRGAMQSVLHHFQRLRGREGGSHFINTSSPRGEAKMSITSDEVNFLVYRYLQESGFSHSAFTFGIESHISQSNINGTLVPPAALISILQKGLQYVEAEISINEDGTVFDGRPIESLSLIDAVMPDVVQTRQQAFREKLAQQQASAAAAAAAATAAATAATTTSAGVSHQNPSKNREATVNGEENRAHSVNNHAKPMEIDGEVEIPSSKATVLRGHESEVFICAWNPVSDLLASGSGDSTARIWNLNENSNGGSTQLVLRHCIREGGHDVPSNKDVTSLDWNTNGTLLATGSYDGFARIWTEDGNLASTLGQHKGPIFALKWNRKGNYILSAGVDKTTIIWDAHTGEAKQQFPFHSAPALDVDWQNNTTFASCSTDMCIHVCRLGCDRPVKTFQGHTNEVNAIKWDPSGMLLASCSDDMTLKIWSMKQEVCIHDLQAHNKEIYTIKWSPTGPATSNPNSNIMLASASFDSTVRLWDIERGVCTHTLTKHQEPVYSVAFSPDGKYLASGSFDKCVHIWNTQSGNLVHSYRGTGGIFEVCWNARGDKVGASASDGSVCVLDLRK

SEQ ID NO: 36969 - protein, 44 aa, Homo sapiens
  ENSP00000415508
MSITSDEVNFLVYRYLQESGFSHSAFTFGIESHISQSNINGTLV

SEQ ID NO: 36970 - protein, 79 aa, Homo sapiens
  ENSP00000397878
MTELAGASSSCCHRPAGRGAMQSVLHHFQRLRGREGGSHFINTSSPRGEAKMSITSDEVNFLVYRYLQESGFSHSAFTF

SEQ ID NO: 36971 - protein, 526 aa, Homo sapiens; identical to SEQ ID NO: 36966
  ENSP00000394097

SEQ ID NO: 36972 - protein, 577 aa, Homo sapiens; identical to SEQ ID NO: 36968
  ENSP00000385988

SEQ ID NO: 36973 - protein, 682 aa, Homo sapiens
  ENSP00000374205
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNIFVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 36974 - protein, 232 aa, Homo sapiens
  ENSP00000393934
FQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFQAEDPGAPSPQRWFVTPANNRLDFAASAYDTATDFAGNAATLLSYAAAGVKALPLQAAGCT

SEQ ID NO: 36975 - protein, 395 aa, Homo sapiens
  ENSP00000387023
MHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 36976 - protein, 466 aa, Homo sapiens
  ENSP00000388736
MELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 36977 - protein, 151 aa, Homo sapiens
  ENSP00000388612
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNE

SEQ ID NO: 36978 - protein, 534 aa, Homo sapiens
  ENSP00000338087
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 36979 - protein, 534 aa, Homo sapiens; identical to SEQ ID NO: 36978
  ENSP00000402536

SEQ ID NO: 36980 - protein, 80 aa, Homo sapiens
  ENSP00000415892
MMEALGFLKLEVNGPMVTVALSVALLALLKWYSTSAFSRLEKLGLRHPKPSPFIGNLTFFRQGFWESQMELRKLYGPLCG

SEQ ID NO: 36981 - protein, 152 aa, Homo sapiens
  ENSP00000391567
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMPQSIMPNSRHHVASRGMWPGGRRLACYLHPFRMAEGIAEV

SEQ ID NO: 36982 - protein, 580 aa, Homo sapiens
  ENSP00000411274
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNELGLLIMQERIKGHMGGQQAPQRIPPTRLSKPSGIYVNLHYATLPFCMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 36983 - protein, 460 aa, Homo sapiens
  ENSP00000411326
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERYRCS

SEQ ID NO: 36984 - protein, 81 aa, Homo sapiens
  ENSP00000412710
MMEALGFLKLEVNGPMVTVALSVALLALLKWYSTSAFSRLEKLGLRHPKPSPFIGNLTFFRQGFWESQMELRKLYGPLCGL

SEQ ID NO: 36985 - protein, 580 aa, Homo sapiens; identical to SEQ ID NO: 36982
  ENSP00000389414

SEQ ID NO: 36986 - protein, 227 aa, Homo sapiens
  ENSP00000332359
MEKLFNENEGMPSNQGKIDNEEQPPHEGKPEVACILEDKKLENEGNTENTGKRVEEPLKDKEKPESAGKAKGEGKSERKGKSEMQGGSKTEGKPERGGRAEGEGEPDSEREPESEGEPESETRAAGKRPAEDDIPRKAKRKTNKGLAQYLKQYKEAIHDMNFSNEDMIREFDNMARVEDKRRKSKQKLGAFLWMQRNLQDPFYPRGPREFRGGCRAPRRDTEDIPYV

SEQ ID NO: 36987 - protein, 227 aa, Homo sapiens; identical to SEQ ID NO: 36986
  ENSP00000361866

SEQ ID NO: 36988 - protein, 206 aa, Homo sapiens
  ENSP00000361765
MEKLYKENEGKPENERNLESEGKPEDEGSTEDEGKSDEEEKPDMEGKTECEGKREDEGEPGDEGQLEDEGNQEKQGKSEGEDKPQSEGKPASQAKPESQPRAAEKRPAEDYVPRKAKRKTDRGTDDSPKDSQEDLQERHLSSEEMMRECGDVSRAQEELRKKQKMGGFHWMQRDVQDPFAPRGQRGVRGVRGGGRGQKDLEDVPYV

SEQ ID NO: 36989 - protein, 183 aa, Homo sapiens
  ENSP00000361860
MEKPYNKNEGNLENEGKPEDEVEPDDEGKSDEEEKPDAEGKTECEGKRKAEGEPGDEGQLEDKGSQEKQGKSEGEGKPQGEGKPASQAKPEGQPRAAEKRPAGDYVPRKAKRKTDRGTDDSPKDSQEDLQERHLSSEEMMRECGDVSRAQEELRKKQKMGGFHWMQRDVQDPFAQGDNGVSGE

SEQ ID NO: 36990 - protein, 183 aa, Homo sapiens; identical to SEQ ID NO: 36989
  ENSP00000361859

SEQ ID NO: 36991 - protein, 100 aa, Homo sapiens
  ENSP00000329794
MQKPCKENEGKPKCSVPKREEKRPYGEFERQQTEGNFRQRLLQSLEEFKEDIDYRHFKDEEMTREGDEMERCLEEIRGLRKKFRALHSNHRHSRDRPYPI

SEQ ID NO: 36992 - protein, 100 aa, Homo sapiens; identical to SEQ ID NO: 36991
  ENSP00000361751

SEQ ID NO: 36993 - protein, 104 aa, Homo sapiens
  ENSP00000361745
MKSCQKMEGKPENESEPKHEEEPKPEEKPEEEEKLEEEAKAKGTFRERLIQSLQEFKEDIHNRHLSNEDMFREVDEIDEIRRVRNKLIVMRWKVNRNHPYPYLM

SEQ ID NO: 36994 - protein, 104 aa, Homo sapiens; identical to SEQ ID NO: 36993
  ENSP00000361740

SEQ ID NO: 36995 - protein, 586 aa, Homo sapiens
  ENSP00000357631
MQAGARFQRRRRQLQQQQPRRRQPLLWPMDAEPPPPPPWVWMVPGSAGLLRLSAGVVVPPVLLASAPPPAAPLLPGLPGWPAPSEPVLPLLPLPSAPDSAAAAAAHPFPALHGQWLFGGHSPSLGLPPSSTVELVPVFPHLCPSALATPIGKSWIDKRIPNCKIFFNNSFALDSTWIHPEESRFFHGHEKPRLLANQVAVSLSRPAPASRPLPTVVLAPQPIPGGCHNSLKVTSSPAIAIATAAAAAMVSVDPENLRGPSPSSVQPRHFLTLAPIKIPLRTSPVSDTRTERGRVARPPALMLRAQKSRDGDKEDKEPPPMLGGGEDSTARGNRPVASTPVPGSPWCVVWTGDDRVFFFNPTMHLSVWEKPMDLKDRGDLNRIIEDPPHKRKLEAPATDNSDGSSSEDNREDQDVKTKRNRTEGCGSPKPEEAKREDKGTRTPPPQILLPLEERVTHFRDMLLERGVSAFSTWEKELHKIVFDPRYLLLNSEERKQIFEQFVKTRIKEEYKEKKSKLLLAKEEFKKLLEESKVSPRTTFKEFAEKYGRDQRFRLVQKRKDQEHFFNQFILILKKRDKENRLRLRKMR

SEQ ID NO: 36996 - protein, 588 aa, Homo sapiens
  ENSP00000282111
MPQLGGGGGGGGGGSGGGGGSSAGAAGGGDDLGANDELIPFQDEGGEEQEPSSDSASAQRDLDEVKSSLVNESENQSSSSDSEAERRPQPVRDTFQKPRDYFAEVRRPQDSAFFKGPPYPGYPFLMIPDLSSPYLSNGPLSPGGARTYLQMKWPLLDVPSSATVKDTRSPSPAHLSNKVPVVQHPHHMHPLTPLITYSNDHFSPGSPPTHLSPEIDPKTGIPRPPHPSELSPYYPLSPGAVGQIPHPLGWLVPQQGQPMYSLPPGGFRHPYPALAMNASMSSLVSSRFSPHMVAPAHPGLPTSGIPHPAIVSPIVKQEPAPPSLSPAVSVKSPVTVKKEEEKKPHVKKPLNAFMLYMKEMRAKVVAECTLKESAAINQILGRKWHNLSREEQAKYYELARKERQLHSQLYPTWSARDNYGKKKKRKREKQLSQTQSQQQVQEAEGALASKSKKPCVQYLPPEKPCDSPASSHGSMLDSPATPSAALASPAAPAATHSEQAQPLSLTTKPETRAQLALHSAAFLSAKAAASSSGQMGSQPPLLSRPLPLGSMPTALLASPPSFPATLHAHQALPVLQAQPLSLVTKSAH

SEQ ID NO: 36997 - protein, 28 aa, Homo sapiens
  ENSP00000388984
MKWPLLDVPSSATVKDTRSPSPAHLSNK

SEQ ID NO: 36998 - protein, 556 aa, Homo sapiens
  ENSP00000317334
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 36999 - protein, 332 aa, Homo sapiens
  ENSP00000439447
MPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 37000 - protein, 433 aa, Homo sapiens
  ENSP00000390159
MEGPLSVFGDRSTGETIRSQNVMAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMDWS

SEQ ID NO: 37001 - protein, 401 aa, Homo sapiens
  ENSP00000376008
MSSKIIGINGDFFANMVVDAVLAIKYTDIRGQPRYPVNSVNILKAHGRSQMESMLISGYALNCVVGSQGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYLENYATSMGSREQLAIAEFARSLLVIPNTLAVNAAQDSTDLVAKLRAFHNEAQVNPERKNLKWIGLDLSNGKPRDNKQAGVFEPTIVKVKSLKFATEAAITILRIDDLIKLHPESKDDKHGSYEDAVHSGALND

SEQ ID NO: 37002 - protein, 221 aa, Homo sapiens
  ENSP00000441345
MEGPLSVFGDRSTGETIRSQNGMPKRIVNAKIACLDFSLQKTKMKLGVQVVITDPEKLDQIRQRESDITKERIQKILATGANVILTTGGIDDMCLKYFVEAGAMAVRRVLKRDLKRIAKASGATILSTLANLEGEETFEAAMLGQAEEVVQERICDDELILIKNTKARTSASIILRGANDFMCDEMERSLHDALCVVKRVLESKSVVPGGGAVEAALSIYL

SEQ ID NO: 37003 - protein, 65 aa, Homo sapiens
  ENSP00000440617
MEGPLSVFGDRSTGETIRSQNVMAAASIANIVKSSLGPVGLDKMLVDDIGWFIFFPANFLGCNHY

SEQ ID NO: 37004 - protein, 59 aa, Homo sapiens
  ENSP00000442185
MELLQWEAVRYINENLIVNTDELGRDCLINAAKTSMSSKIIGINGDFFANMVVDAVLAI

SEQ ID NO: 37005 - protein, 100 aa, Homo sapiens
  ENSP00000444423
MEGPLSVFGDRSTGETIRSQNVMAAASIANIVKSSLGPVGLDKMLVDDIGDVTITNDGATILKLLEVEHPAAKVLCELADLQDKEVGDGTTSVGSSALYQ

SEQ ID NO: 37006 - protein, 136 aa, Homo sapiens
  ENSP00000439671
MAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYINENLIVNTDELGRDCLINAAKTSMSS

SEQ ID NO: 37007 - protein, 111 aa, Homo sapiens
  ENSP00000437840
MAAASIANIVKSSLGPVGLDKMLVDDIGDVTITNDGATILKLLEVEHPAAKVLCELADLQDKEVGDGTTSVVIIAAELLKNADELVKQKIHPTSVISGYRLACKEAVRYIN

SEQ ID NO: 37008 - protein, 91 aa, Homo sapiens
  ENSP00000442856
MAAASIANIVKSSLGPVGLDKMLVDDIGDVTITNDGATILKLLEVEHPAAKVLCELADLQDKEVGDGTTSVVIIAAELLKNADELVKQKIH

SEQ ID NO: 37009 - protein, 17 aa, Homo sapiens
  ENSP00000447416
MPFNGEKQCVGEDQPSD

SEQ ID NO: 37010 - protein, 266 aa, Homo sapiens
  ENSP00000448952
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPRKAEVAGAS

SEQ ID NO: 37011 - protein, 519 aa, Homo sapiens
  ENSP00000299045
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSALDQTTEWIKESVNEELFSLSESALTPGAENTSKPSLSPTLVLNNSYLKLLQWDYQKKELPETLMTDGARLQELTEKLNQLKIIACLSLITNNMVGAITGGLPELASRLTRISAVLLEGMNKETFNLKEVLNSIGIQTCVEVNKTLMERGLPTLNAEIQANLIGQFSSIEEEDNPIWSLIDKRIKLYMRRLLCLPSPQKCMPPMPGGLAVIQQELEALGSQYANIVNLNKQVYGPFYANILRKLLFNEEAMGKVDASPPTN

SEQ ID NO: 37012 - protein, 272 aa, Homo sapiens
  ENSP00000449123
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLRPHLQRQLVEYERTKFQEILEETPSEYNIMCIYIEIRLK

SEQ ID NO: 37013 - protein, 234 aa, Homo sapiens
  ENSP00000448629
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIKLFEEIREILLSFLTPGGNRLRNQICEVLDTDLIRQQAEHSAVDIQGLANYVISTMGKLCAPVRDNDIRELKATGNIVEVLRQIFHVLDLMQMDMANFTIMSLR

SEQ ID NO: 37014 - protein, 60 aa, Homo sapiens
  ENSP00000448064
MPFNGEKQCVGEDQPSDSDSSRFSESMASLSDYECSRQSFASDSSSKSSSPALLYEHLTA

SEQ ID NO: 37015 - protein, 131 aa, Homo sapiens
  ENSP00000447174
MPFNGEKQCVGEDQPSDSDSSRFSESMASLSDYECSRQSFASDSSSKSSSPASTSPPRVVTFDEVMATARNLSNLTLAHEIAVNENFQLKQEALPEKSLAGRVKHIVHQAFWDVLDSELNADPPEFEHAIK

SEQ ID NO: 37016 - protein, 97 aa, Homo sapiens
  ENSP00000447457
MPFNGEKQCVGEDQPSDSDSSRFSESMASLSDYECSRQSFASDSSSKSSSPASTSPPRVVTFDEVMATARNLSNLTLAHEIAVNENFQLKQEALPEK

SEQ ID NO: 37017 - protein, 17 aa, Homo sapiens
  ENSP00000449844
MPFNGEKQCVGEDQPSD

SEQ ID NO: 37018 - protein, 501 aa, Homo sapiens
  ENSP00000360560
MQDTVTTSALLDPSHSSVSTQDNSSTGGHTSSTSPQLSKPSITPVPAKSRNPHPRANIRRMRRIIAEDPEWSLAIVPLLTELCIQHIIRNFQKNPILKQMLPEHQQKVLNHLSPDLPLAVTANLIDSENYWLRCCMHRWPVCHVAHHGGSWKRMFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKIFKLTRSKVDDDKARIIIRSLLDHPVLEELDLSQNLIGDRGARGAAKLLSHSRLRVLNLANNQVRAPGAQSLAHALAHNTNLISLNLRLNCIEDEGGQALAHALQTNKCLTTLHLGGNELSEPTATLLSQVLAINTTLTSINLSCNHIGLDGGKQLLEGMSDNKTLLEFDLRLSDVAQESEYLIGQALYANREAARQRALNPSHFMSTITANGPENSVG

SEQ ID NO: 37019 - protein, 198 aa, Homo sapiens
  ENSP00000360559
MFFERHLENLLKHFIPGTTDPAVILDLLPLCRNYVRRVHVDQFLPPVQLPAQLRPGDQSDSGSEGEMEEPTVDHYQLGDLVAGLSHLEELDLVYDVKDCGMNFEWNLFLFTYRDCLSLAAAIKACHTLKDGGKQLLEGMSDNKTLLEFDLRLSDVAQESEYLIGQALYANREAARQRALNPSHFMSTITANGPENSVG

SEQ ID NO: 37020 - protein, 179 aa, Homo sapiens
  ENSP00000282670
MMMSDNAKGRAAHSWKKRGSISSLSNHEFWRKEIHGRIKDSMSTVSYMEEPSQRDDISRLTVQMENTYQLGPPKHFPVVTVNHILKDVVTSYLQVEEYEPELCRQMTKTISEVIKAQVKDLMIPRYKLIVIVHIGQLNRQSILIGSRCLWDPKSDTFSSYVFRNSSLFALANVYAVYLE

SEQ ID NO: 37021 - protein, 76 aa, Homo sapiens
  ENSP00000436731
MMMSDNAKGRAAHSWKKRGSISSLSNHEFWRKEIHGRIKDSMSTVSYMEEPSQRDDISRLTVQMENTYQLAQYKGL

SEQ ID NO: 37022 - protein, 191 aa, Homo sapiens
  ENSP00000452042
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKGQSYE

SEQ ID NO: 37023 - protein, 589 aa, Homo sapiens
  ENSP00000377098
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFAPAKRIKDEVEASFSGSRQFQSETEVLRWQPGANGHLSCAI

SEQ ID NO: 37024 - protein, 279 aa, Homo sapiens
  ENSP00000450872
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVI

SEQ ID NO: 37025 - protein, 608 aa, Homo sapiens
  ENSP00000377099
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKDRPWIWNIPYVKAPDTHGNMWVPS

SEQ ID NO: 37026 - protein, 219 aa, Homo sapiens
  ENSP00000450708
MPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTH

SEQ ID NO: 37027 - protein, 608 aa, Homo sapiens; identical to SEQ ID NO: 37025
  ENSP00000337353

SEQ ID NO: 37028 - protein, 151 aa, Homo sapiens
  ENSP00000452279
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEG

SEQ ID NO: 37029 - protein, 146 aa, Homo sapiens
  ENSP00000451358
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYE

SEQ ID NO: 37030 - protein, 147 aa, Homo sapiens
  ENSP00000452333
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYET

SEQ ID NO: 37031 - protein, 298 aa, Homo sapiens
  ENSP00000444587
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGTHL

SEQ ID NO: 37032 - protein, 259 aa, Homo sapiens
  ENSP00000452363
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQENDAAAL

SEQ ID NO: 37033 - protein, 161 aa, Homo sapiens
  ENSP00000452183
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKG

SEQ ID NO: 37034 - protein, 578 aa, Homo sapiens
  ENSP00000450628
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGIWLSPLYPRIADGTHKSGESPTHFKADLISYLMAYNAPSLKEWIDVIHKHDLSETNVYLIGSTPGRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFIGHGYGTFLMSKHRIRMGTCGCPPENLEAL

SEQ ID NO: 37035 - protein, 51 aa, Homo sapiens
  ENSP00000451767
AKLDIAFGTHHTKMMLLLYEEGLRVVIHTSNLIHADWHQKTQGHFVHLCLC

SEQ ID NO: 37036 - protein, 281 aa, Homo sapiens
  ENSP00000450795
  MOD_RES (1)..(1): Any amino acid
XRFQGSQKDNWGHFRLKKLLKDHASSMPNAESWPVVGQFSSVGSLGADESKWLCSEFKESMLTLGKESKTPGKSSVPLYLIYPSVENVRTSLEGYPAGGSLPYSIQTAEKQNWLHSYFHKWSAETSGRSNAMPHIKTYMRPSPDFSKIAWFLVTSANLSKAAWGALEKNGTQLMIRSYELGVLFLPSAFGLDSFKVKQKFFAGSQEPMATFPVPYDLPPELYGSKGETQIKENHGWICIRKTNRAQEKPLVSVGSWLMEPSGSSSLQRALCQPVWGLVATG

SEQ ID NO: 37037 - protein, 426 aa, Homo sapiens
  ENSP00000435233
IEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 37038 - protein, 159 aa, Homo sapiens
  ENSP00000432587
  MOD_RES (1)..(1): Any amino acid
XDAPPPLHLCPERGQQPSAPAGPGAGAVLGRGGVAGPRDREPGREPGTEQRAGEAAPKFASDSPGAAVAPWAEVYFLEKAPGFGLENPTAKIEPSSWSGSESPAENMERMSDSADKPIDNDAEGVWSPDIEQSFQEALAIYPPCGRRKIILSDEGKMYG

SEQ ID NO: 37039 - protein, 368 aa, Homo sapiens
  ENSP00000435977
IEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 37040 - protein, 330 aa, Homo sapiens
  ENSP00000435393
MRYVLSWCVTVTFKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 37041 - protein, 426 aa, Homo sapiens
  ENSP00000491500
MEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 37042 - protein, 357 aa, Homo sapiens
  ENSP00000334754
MERMSDSADKPIDNDAEGVWSPDIEQSFQEALAIYPPCGRRKIILSDEGKMYGRNELIARYIKLRTGKTRTRKQVSSHIQVLARRKSRDFHSKLKVTSMDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 37043 - protein, 391 aa, Homo sapiens
  ENSP00000351184
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 37044 - protein, 22 aa, Homo sapiens
  ENSP00000438960
LEGTAGTITSNEWSSPTSPEGS

SEQ ID NO: 37045 - protein, 72 aa, Homo sapiens
  ENSP00000438453
LEGTAGTITSNEWSSPTSPEGSTASGGSQALDKPIDNDAEGVWSPDIEQSFQEALAIYPPCGRRKIILSDEG

SEQ ID NO: 37046 - protein, 434 aa, Homo sapiens
  ENSP00000352926
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 37047 - protein, 175 aa, Homo sapiens
  ENSP00000444528
LEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSH

SEQ ID NO: 37048 - protein, 305 aa, Homo sapiens
  ENSP00000380311
MAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 37049 - protein, 110 aa, Homo sapiens
  ENSP00000411475
LEGTAGTITSNEWSSPTSPEGSTASGGSQALDKPIDNDAEGVWSPDIEQSFQEALAIYPPCGRRKIILSDEGKMYGLQPHPGAGSSQSSRDPGQAKVLARSFARPSRNVP

SEQ ID NO: 37050 - protein, 189 aa, Homo sapiens
  ENSP00000441959
  MOD_RES (1)..(1): Any amino acid
XGKTRTRKQVSSHIQVLARRKAREIQAKLKTGAELGTCGREDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVD

SEQ ID NO: 37051 - protein, 631 aa, Homo sapiens
  ENSP00000370912
MNFNTILEEILIKRSQQKKKTSPLNYKERLFVLTKSMLTYYEGRAEKKYRKGFIDVSKIKCVEIVKNDDGVIPCQNKYPFQVVHDANTLYIFAPSPQSRDLWVKKLKEEIKNNNNIMIKYHPKFWTDGSYQCCRQTEKLAPGCEKYNLFESSIRKALPPAPETKKRRPPPPIPLEEEDNSEEIVVAMYDFQAAEGHDLRLERGQEYLILEKNDVHWWRARDKYGNEGYIPSNYVTGKKSNNLDQYEWYCRNMNRSKAEQLLRSEDKEGGFMVRDSSQPGLYTVSLYTKFGGEGSSGFRHYHIKETTTSPKKYYLAEKHAFGSIPEIIEYHKHNAAGLVTRLRYPVSVKGKNAPTTAGFSYEKWEINPSELTFMRELGSGLFGVVRLGKWRAQYKVAIKAIREGAMCEEDFIEEAKVMMKLTHPKLVQLYGVCTQQKPIYIVTEFMERGCLLNFLRQRQGHFSRDVLLSMCQDVCEGMEYLERNSFIHRDLAARNCLVSEAGVVKVSDFGMARYVLDDQYTSSSGAKFPVKWCPPEVFNYSRFSSKSDVWSFGVLMWEVFTEGRMPFEKYTNYEVVTMVTRGHRLYQPKLASNYVYEVMLRCWQEKPEGRPSFEDLLRTIDELVECEETFGR

SEQ ID NO: 37052 - protein, 100 aa, Homo sapiens
  ENSP00000424567
MNFNTILEEILIKRSQQKKKTSPLNYKERLFVLTKSMLTYYEGRAEKKYRKGFIDVSKIKCVEIVKNDDGVIPCQNKYPFQSTKQGPVGEEVKRRNKEQQ

SEQ ID NO: 37053 - protein, 51 aa, Homo sapiens
  ENSP00000424365
MRELGSGLFGVVRLGKWRAQYKVAIKAIREGAMCEEDFIEEAKVMMLPEIV

SEQ ID NO: 37054 - protein, 976 aa, Homo sapiens
  ENSP00000430686
MDSLASLVLCGVSLLLSASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 37055 - protein, 1124 aa, Homo sapiens
  ENSP00000369375
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 37056 - protein, 1081 aa, Homo sapiens
  ENSP00000383977
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 37057 - protein, 468 aa, Homo sapiens
  ENSP00000428337
MDSLASLVLCGVSLLLSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVIS

SEQ ID NO: 37058 - protein, 468 aa, Homo sapiens
  ENSP00000480251
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVSMEKQRLTKANSDK

SEQ ID NO: 37059 - protein, 421 aa, Homo sapiens
  ENSP00000350937
MDLENKVKKMGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 37060 - protein, 79 aa, Homo sapiens
  ENSP00000413002
MYKRNVMILTNPVAAKKNVSINTVTYEWAPPVQNQALARQYMQMLPKEKQPVAGSEGAQYRKKQLAKQLPAHDQDPSKC

SEQ ID NO: 37061 - protein, 44 aa, Homo sapiens
  ENSP00000420220
MDLENKVKKMGLGHEQGFGAPCLKCKEKCEGFELHFWSPAIAAN

SEQ ID NO: 37062 - protein, 412 aa, Homo sapiens
  ENSP00000377121
MGLGHEQGFGAPCLKCKEKCEGFELHFWRKICRNCKCGQEEHDVLLSNEEDRKVGKLFEDTKYTTLIAKLKSDGIPMYKRNVMILTNPVAAKKNVSINTVTYEWAPPVQNQALARQYMQMLPKEKQPVAGSEGAQYRKKQLAKQLPAHDQDPSKCHELSPREVKEMEQFVKKYKSEALGVGDVKLPCEMDAQGPKQMNIPGGDRSTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVCQGCHNAIDPEVQRVTYNNFSWHASTECFLCSCCSKCLIGQKFMPVEGMVFCSVECKKRMS

SEQ ID NO: 37063 - protein, 192 aa, Homo sapiens
  ENSP00000377124
  MOD_RES (1)..(1): Any amino acid
XTPAAVGAMEDKSAEHKRTQYSCYCCKLSMKEGDPAIYAERAGYDKLWHPACFVCSTCHELLVDMIYFWKNEKLYCGRHYCDSEKPRCAGCDELIFSNEYTQAENQNWHLKHFCCFDCDSILAGEIYVMVNDKPVCKPCYVKNHAVVRSVLRIWLPQPALGLEFMLFLKPLTNGKQKAVLLSRKQIIPTTGC

SEQ ID NO: 37064 - protein, 163 aa, Homo sapiens
  ENSP00000432716
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVKWSRSCCRETLTSRRSPLAPSPTGP

SEQ ID NO: 37065 - protein, 214 aa, Homo sapiens
  ENSP00000334785
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 37066 - protein, 81 aa, Homo sapiens
  ENSP00000450386
PHVRLGQRRPHHSGRISKCKVVEELLSGNPHIEKESARSIADGAMMEAASVCMGQMIWQGIDIETKMHVRFLNMETMALCH

SEQ ID NO: 37067 - protein, 135 aa, Homo sapiens
  ENSP00000432608
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRSCGFLGLEGGCAVDVKQGP

SEQ ID NO: 37068 - protein, 187 aa, Homo sapiens
  ENSP00000445689
MGAAHSASEEVRELEGKTGFSSDQIEQLHRRFKQLSGDQPTIRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 37069 - protein, 1491 aa, Homo sapiens
  ENSP00000374584
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSHQSMQSTCSPESSEDITDEFLTPDGEYFYSSTAQENLALETSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 37070 - protein, 1497 aa, Homo sapiens
  ENSP00000240361
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKAMPWFQFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSHQSMQSTCSPESSEDITDEFLTPDGEYFYSSTAQENLALETSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 37071 - protein, 1451 aa, Homo sapiens
  ENSP00000268910
MSRAVRLPVPCPVQLGTLRNDSLEAQLHEYVKQGNYVKVKKILKKGIYVDAVNSLGQTALFVAALLGLRKFVDVLVDYGSDPNHRCFDGSTPVHAAAFSGNQWILSKLLDAGGDLRLHDERGQNPKTWALTAGKERSTQIVEFMQRCASHMQAIIQGFSYDLLKKIDSPQRLVYSPSWCGGLVQGNPNGSPNRLLKAGVISAQNIYSFGFGKFYLTGATQMAYLGSLPVIGEKEVIQADDEPTFSFFSGPYMVMTNLVWNGSRVTVKELNLPTHPHCSRLRLADLLIAEQEHSSKLRHPYLLQLMAVCLSQDLEKTRLVYERITIGTLFSVLHERRSQFPVLHMEVIVHLLLQISDALRYLHFQGFIHRSLSSYAVHIISPGEARLTNLEYMLESEDRGVQRDLTRVPLPTQLYNWAAPEVILQKAATVKSDIYSFSMIMQEILTDDIPWKGLDGSVVKKAVVSGNYLEADVRLPKPYYDIVKSGIHVKQKDRTMNLQDIRYILKNDLKDFTGAQRTQPTESPRVQRYGLHPDVNVYLGLTSEHPRETPDMEIIELKEMGSQPHSPRVHSLFTEGTLDPQAPDPCLMARETQNQDAPCPAPFMAEEASSPSTGQPSLCSFEINEIYSGCLILEDDIEEPPGAASSLEADGPNQVDELKSMEEELDKMEREACCFGSEDESSSKAETEYSFDDWDWQNGSLSSLSLPESTREAKSNLNNMSTTEEYLISKCVLDLKIMQTIMHENDDRLRNIEQILDEVEMKQKEQEERMSLWATSREFTNAYKLPLAVGPPSLNYIPPVLQLSGGQKPDTSGNYPTLPRFPRMLPTLCDPGKQNTDEQFQCTQGAKDSLETSRIQNTSSQGRPRESTAQAKATQFNSALFTLSSHRQGPSASPSCHWDSTRMSVEPVSSEIYNAESRNKDDGKVHLKWKMEVKEMAKKAATGQLTVPPWHPQSSLTLESEAENEPDALLQPPIRSPENTDWQRVIEYHRENDEPRGNGKFDKTGNNDCDSDQHGRQPRLGSFTSIRHPSPRQKEQPEHSEAFQASSDTLVAVEKSYSTSSPIEEDFEGIQGAFAQPQVSGEEKFQMRKILGKNAEILPRSQFQPVRSTEDEQEETSKESPKELKEKDISLTDIQDLSSISYEPDSSFKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIELLKQQQGSSTVLHENTASDGGGTANDQRHLEEQETDSKKEDSSMLLSKETEDLGEDTERAHSTLDEDLERWLQPPEESVELQDLPKGSERETNIKDQKVGEEKRKREDSITPERRKSEGVLGTSEEDELKSCFWKRLGWSESSRIIVLDQSDLSD

SEQ ID NO: 37072 - protein, 66 aa, Homo sapiens
  ENSP00000463593
MSRAVRLPVPCPVQLGTLRNDSLEAQLHEYVKQGNYVKVKKILKKALELPQTALRSEEEWRSKEEN

SEQ ID NO: 37073 - protein, 152 aa, Homo sapiens
  ENSP00000463243
  MOD_RES (1)..(1): Any amino acid
XKEASCKTPKINHAPTSVSTPLSPGSVSSAASQYKDCLESITFQVKTEFASCWNSQEFIQTLSDDFISVRERAKKLDSLLTSSETPPSRLTGLKRLSSFIGAGSPSLVKACDSSPPHATQRRSLPKVEAFSQHHIDELPPPSQELLDDIVAV

SEQ ID NO: 37074 - protein, 1134 aa, Homo sapiens
  ENSP00000258991
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPAPVFLAPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 37075 - protein, 1127 aa, Homo sapiens
  ENSP00000462665
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 37076 - protein, 1127 aa, Homo sapiens; identical to SEQ ID NO: 37075
  ENSP00000463001

SEQ ID NO: 37077 - protein, 626 aa, Homo sapiens
  ENSP00000462230
  MOD_RES (1)..(1): Any amino acid
XGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 37078 - protein, 52 aa, Homo sapiens
  ENSP00000463286
MTSLYGRHAEKTTDMPKPSAPKVHVQRSVSRDTIAIHFSASGEEEEEEEEEF

SEQ ID NO: 37079 - protein, 42 aa, Homo sapiens
  ENSP00000462210
MTSLYGRHAEKTTDMPKPSAPKVHVQRSVSRDTIAIHFSASG

SEQ ID NO: 37080 - protein, 1127 aa, Homo sapiens [sequence omitted]

SEQ ID NO: 37081 - protein, 129 aa, Homo sapiens
  ENSP00000431764
MTKGRRFNPPSDKDGRWFPHIGLTQKTPESITSATSKEPQSPHLPRQAEGKLPPIYKVREKQAVNNQFPFSVHDNRHSLENSGCYLDSERMTATDPQGEPDKRQEFYEPVRTQSIPHPGLRTNAPLLAV

SEQ ID NO: 37082 - protein, 99 aa, Homo sapiens
  ENSP00000434299
MTKGRRFNPPSDKDGRWFPHIGLTQKTPESITSATSKEPQSPHLPRQAEGKLPPIYKVREKQAVNNQFPFSVHDNRHSLENSGCYLDSFADGLSWDFSL

SEQ ID NO: 37083 - protein, 186 aa, Homo sapiens
  ENSP00000357811
MTKGRRFNPPSDKDGRWFPHIGLTQKTPESITSATSKEPQSPHLPRQAEGKLPPIYKVREKQAVNNQFPFSVHDNRHSLENSGCYLDSGLGRKKISPDKRQHVSRNFNLWACDYVPSCLDGFSNNQISYVYKEAMVVSSFRRFPRCYKEIWNAFTFLPERSYTEVLKKKPKVRFTVDKKVVSSLES

SEQ ID NO: 37084 - protein, 104 aa, Homo sapiens
  ENSP00000452791
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDD

SEQ ID NO: 37085 - protein, 391 aa, Homo sapiens
  ENSP00000342169
MAGRSLCLTRSSVPGTPFPPPVQQPSTPGPDLLALEEEYKRLNAELQAKTADVVQQAKEIIRDRQEVRSRPVSTQMKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERELENKRRLQKQAASSQSATEVRLNRALEEAEKYKLELSKLRQNNKDIANEEHKKIEVLKSENKKLEKQKGELMIGFKKQLKLIDVLKRQKMHIEAAKMLSFTEEEFMKALEWGNS

SEQ ID NO: 37086 - protein, 316 aa, Homo sapiens
  ENSP00000438745
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERELENKRRLQKQAASSQSATEVRLNRALEEAEKYKLELSKLRQNNKDIANEEHKKIEVLKSENKKLEKQKGELMIGFKKQLKLIDVLKRQKMHIEAAKMLSFTEEEFMKALEWGNS

SEQ ID NO: 37087 - protein, 283 aa, Homo sapiens
  ENSP00000456593
MAGRSLCLTRSSVPGTPFPPPVQQPSTPGPDLLALEEEYKRLNAELQAKTADVVQQAKEIIRDRQEVRSRPVSTQMKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERVIIWYFS

SEQ ID NO: 37088 - protein, 79 aa, Homo sapiens
  ENSP00000453431
MAGRSLCLTVSSTPGSWGASGFRRLGRLTSFNFGSESLWLFYREAAFQGLRSRHPFSNPLHLDPTSSPWRKNISKKFGG

SEQ ID NO: 37089 - protein, 208 aa, Homo sapiens
  ENSP00000453398
MKSCDDEDDYSLRGLLPSEGIVHLHSETKPKTKNIDPVNKVQNKLHSANKGRKTNSSVKLKYSDVQTADDVAIPEDFSDFSLAKTISKIEGQLEEEGLPEYIDDIFSGVSNDIGTEAQIRFLKAKLHVMQEELDNVVCECNKKEDEIQNLKSQVKNFEEDFMRQQRTINMQQSQVEKYKTLFEEANKKYDGLQQQLSSVERVIIWYFS

SEQ ID NO: 37090 - protein, 102 aa, Homo sapiens
  ENSP00000453960
MQQSQVEKYKTLFEEANKKYDGLQQQLSSVERELENKRRLQKQAASSQSATEVRLNRALEEAEKYKLELSKLRQNNKMHIEAAKMLSFTEEEFMKALEWGNS

SEQ ID NO: 37091 - protein, 81 aa, Homo sapiens
  ENSP00000417735
  MOD_RES (1)..(1): Any amino acid
XYKVTVAEVQRRLSPPECLNASLLGGVLRRAKSKNGGRSLREKLDKIGLNLPAGRRKAANVTLLTSLVEGAEMAAVLRQEY

SEQ ID NO: 37092 - protein, 439 aa, Homo sapiens
  ENSP00000368933
MKMLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 37093 - protein, 113 aa, Homo sapiens
  ENSP00000420568
MLVHSFSAMDRHDGTSNGTARLPQLGTPEPPARPAAAAAPRLARPEAEPGVWAPAHAPGAASPAVGPGSSQGLQAARGPPARPTRAQLRTRRPLDPLLTSRHRGGPACRRPGY

SEQ ID NO: 37094 - protein, 433 aa, Homo sapiens
  ENSP00000316516
MSILAKMGDWQDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 37095 - protein, 431 aa, Homo sapiens
  ENSP00000368928
MLVHSFSAMDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 37096 - protein, 121 aa, Homo sapiens
  ENSP00000419823
MKMLWKLTDNIKYEDCEDRHDGTSNGTARLPQLGTPEPPARPAAAAAPRLARPEAEPGVWAPAHAPGAASPAVGPGSSQGLQAARGPPARPTRAQLRTRRPLDPLLTSRHRGGPACRRPGY

SEQ ID NO: 37097 - protein, 437 aa, Homo sapiens
  ENSP00000418541
MLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 37098 - protein, 328 aa, Homo sapiens
  ENSP00000417495
MLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEDRYAKSSPTCWLRTDLPWGTHGPTPSWSPASRAA

SEQ ID NO: 37099 - protein, 218 aa, Homo sapiens
  ENSP00000419696
  MOD_RES (1)..(1): Any amino acid
XPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEVVIFPDKCIHQILQRRK

SEQ ID NO: 37100 - protein, 136 aa, Homo sapiens
  ENSP00000419961
MKMLWKLTDNIKYEDCEHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAG

SEQ ID NO: 37101 - protein, 173 aa, Homo sapiens
  ENSP00000418391
MEEPRSSGQPSPESQTRLRSGGARGQTGPGSACRAESPTSARTRSQAAPTRYARPPLHPEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYR

SEQ ID NO: 37102 - protein, 198 aa, Homo sapiens
  ENSP00000342252
MLWKLVENVKYEDIYEMLVHTYSSMDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKK

SEQ ID NO: 37103 - protein, 460 aa, Homo sapiens
  ENSP00000377265
MHSPPRDQAAIMLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 37104 - protein, 118 aa, Homo sapiens
  ENSP00000414015
AAAEVAGQFVIKLTHDVELNLDYERYNSQLLSFVRDLNQYRADIKEMGLSLQWLYSARGDFFRATSRLTTDFGNAEKTDRFVMKKLNDRVMREGPQMMLLLTDARPSNHFLSPLLSLH

SEQ ID NO: 37105 - protein, 679 aa, Homo sapiens
  ENSP00000390133
MIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 37106 - protein, 760 aa, Homo sapiens
  ENSP00000353224
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 37107 - protein, 760 aa, Homo sapiens; identical to SEQ ID NO: 37106
  ENSP00000376197

SEQ ID NO: 37108 - protein, 81 aa, Homo sapiens
  ENSP00000402839
MMDQARSAFSNLFGGEPLSYTRFSLARQVDGDNSHVEMKLAVDEEENADNNTKANVTKPKRCSGSICYGTIAVIVFFLIGC

SEQ ID NO: 37109 - protein, 59 aa, Homo sapiens
  ENSP00000427871
MALVLEIFTLLASICWVSANIFEYQVDAQPLRPCELQRETAFLKQADYVPQCAEDGSFQ

SEQ ID NO: 37110 - protein, 2768 aa, Homo sapiens
  ENSP00000220616
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLDEIYDTIFAGLDLPSTFTETTLYRILQRRFLAVQSVISGRFRCPTKCEVERFTATSFGHPYVPSCRRNGDYQAVQCQTEGPCWCVDAQGKEMHGTRQQGEPPSCAEGQSCASERQQALSRLYFGTSGYFSQHDLFSSPEKRWASPRVARFATSCPPTIKELFVDSGLLRPMVEGQSQQFSVSENLLKEAIRAIFPSRGLARLALQFTTNPKRLQQNLFGGKFLVNVGQFNLSGALGTRGTFNFSQFFQQLGLASFLNGGRQEDLAKPLSVGLDSNSSTGTPEAAKKDGTMNKPTVGSFGFEINLQENQNALKFLASLLELPEFLLFLQHAISVPEDVARDLGDVMETVLSSQTCEQTPERLFVPSCTTEGSYEDVQCFSGECWCVNSWGKELPGSRVRGGQPRCPTDCEKQRARMQSLMGSQPAGSTLFVPACTSEGHFLPVQCFNSECYCVDAEGQAIPGTRSAIGKPKKCPTPCQLQSEQAFLRTVQALLSNSSMLPTLSDTYIPQCSTDGQWRQVQCNGPPEQVFELYQRWEAQNKGQDLTPAKLLVKIMSYREAASGNFSLFIQSLYEAGQQDVFPVLSQYPSLQDVPLAALEGKRPQPRENILLEPYLFWQILNGQLSQYPGSYSDFSTPLAHFDLRNCWCVDEAGQELEGMRSEPSKLPTCPGSCEEAKLRVLQFIRETEEIVSASNSSRFPLGESFLVAKGIRLRNEDLGLPPLFPPREAFAEQFLRGSDYAIRLAAQSTLSFYQRRRFSPDDSAGASALLRSGPYMPQCDAFGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQCPSLCNVLKSGVLSRRVSPGYVPACRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQRPQLWQTIQTQGHFQLQLPPGKMCSADYADLLQTFQVFILDELTARGFCQIQVKTFGTLVSIPVCNNSSVQVGCLTRERLGVNVTWKSRLEDIPVASLPDLHDIERALVGKDLLGRFTDLIQSGSFQLHLDSKTFPAETIRFLQGDHFGTSPRTWFGCSEGFYQVLTSEASQDGLGCVKCPEGSYSQDEECIPCPVGFYQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGQGSTTTLQKRFEPTGFQNMLSGLYNPIVFSASGANLTDAHLFCLLACDRDLCCDGFVLTQVQGGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 37111 - protein, 147 aa, Homo sapiens
  ENSP00000428628
  MOD_RES (1)..(1): Any amino acid
XSAGASALLRSGPYMPQCDAFGSWEPVQCHAGTGHCWCVDEKGGFIPGSLTARSLQIPQCPTTCEKSRTSGLLSSWKQARSQENPSPKDLFVPACLEARGVRCHSTRRRWLVEQSCVRQSRAPQALPCSSANCCAARAPGACFHQGH

SEQ ID NO: 37112 - protein, 226 aa, Homo sapiens
  ENSP00000429605
  MOD_RES (1)..(1): Any amino acid
XGSWEPVQCHAGTGHCWCVDEKGGFIPGSLTARSLQIPQCPTTCEKSRTSGLLSSWKQARSQENPSPKDLFVPACLETGEYARLQASGAGTWCVDPASGEELRPGSSSSAQSCRAEDGGFSPVQCDQAQGSCWCVMDSGEEVPGTRVTGGQPACESPRCPLPFNASEVVGGTILCETISGPTGSAMQQCQLLCRQGSWSVFPPGPLICSLESGRWESQLPQPRACQ

SEQ ID NO: 37113 - protein, 1224 aa, Homo sapiens
  ENSP00000430523
  MOD_RES (1)..(1): Any amino acid
XQEQAGSLACVPCPVGRTTISAGAFSQTHCVTDCQRNEAGLQCDQNGQYRASQKDRGSGKAFCVDGEGRRLPWWETEAPLEDSQCLMMQKFEKVPESKVIFDANAPVAVRSKVPDSEFPVMQCLTDCTEDEACSFFTVSTTEPEISCDFYAWTSDNVACMTSDQKRDALGNSKATSFGSLRCQVKVRSHGQDSPAVYLKKGAIICGLLSSPSVLLCNVKDWMDPSEAWANATCPGVTYDQESHQVILRLGDQEFIKSLTPLEGTQDTFTNFQQVYLWKDSDMGSRPESMGCRKDTVPRPASPTEAGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPIAQNNAPSFCPLVVLPSLTEKVSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 37114 - protein, 62 aa, Homo sapiens
  ENSP00000429164
  MOD_RES (1)..(1): Any amino acid
XSDMGSRPESMGCRKDTVPRPASPTEAGCVQEHSFCQLAEITESASLYFTCTLYPEAQVCDD

SEQ ID NO: 37115 - protein, 901 aa, Homo sapiens
  ENSP00000430430
MLPGLTTELFSPVDLNQVIVNGNQSLSSQKHWLFKHLFSAQQANLWCLSRCVQEHSFCQLAEITESASLYFTCTLYPEAQVCDDIMESNAQGCRLILPQMPKALFRKKVILEDKVKNFYTRLPFQKLMGISIRNKVPMSEKSISNGFFECERRCDADPCCTGFGFLNVSQLKGGEVTCLTLNSLGIQMCSEENGGAWRILDCGSPDIEVHTYPFGWYQKPMSLDSWQSLALSSVVVDPSIRHFDVAHVSTAATSNFSAVRDLCLSECSQHEACLITTLQTQPGAVRCMFYADTQSCTHSLQGQNCRLLLREEATHIYRKPGISLLSYEASVPSVPISTHGRLLGRSQAIQVGTSWKQVDQFLGVPYAAPPLAERRFQAPEPLNWTGSWDASKPRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLTARATNSQLFRRAVLMGGSALSPAAVISHERAQQQAIALAKEVSCPMSSSQEVVSCLRQKPANVLNDAQTKLLAVSGPFHYWGPVIDGHFLREPPARALKRSLWVEVDLLIGSSQDDGLINRAKAVKQFEESRGRTSSKTAFYQALQNSLGGEDSDARVEAAATWYYSLEHSTDDYASFSRALENATRDYFIICPIIDMASAWAKRARGNVFMYHAPENYGHGSLELLADVQFALGLPFYPAYEGQFSLEEKSLSLKIMQYFSHFIRSGNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 37116 - protein, 74 aa, Homo sapiens
  ENSP00000430087
  MOD_RES (1)..(1): Any amino acid
XGIQMCSEENGGAWRILDCGSPDIEVHTYPFGWYQKPIAQNNAPSFCPLVVLPSLTEKVFKVREVRGTQLKRME

SEQ ID NO: 37117 - protein, 194 aa, Homo sapiens
  ENSP00000429761
  MOD_RES (1)..(1): Any amino acid
XHSECQWREHSLRPLPFLTPFSSLSQQESLCSAMRHLYLLCPFPPMAGCWAGPRPSRASCWQPGTRTSTSPGVSEDCLYLNVFIPQNVAPNASVLVFFHNTMDREESEGWPAIDGSFLAAVGNLIVVTASYRVGVFGFLSSGSGEVSGNWGLLDQVAALTWVQTHIRGFGGDPRRVSLAADRGGADVASIHLLT

SEQ ID NO: 37118 - protein, 172 aa, Homo sapiens
  ENSP00000430161
SDARVEAAATWYYSLEHSTDDYASFSRALENATRDYFIICPIIDMASAWAKRARGNVFMYHAPENYGHGRNPNYPYEFSRKVPTFATPWPDFVPRAGGENYKEFSELLPNRQGLKKADCSFWSKYISSLKTSADGAKGGQSAESEEEELTAGSGLREDLLSLQEPGSKTYSK

SEQ ID NO: 37119 - protein, 414 aa, Homo sapiens
  ENSP00000355897
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 37120 - protein, 442 aa, Homo sapiens
  ENSP00000355896
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 37121 - protein, 309 aa, Homo sapiens
  ENSP00000451110
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFR

SEQ ID NO: 37122 - protein, 412 aa, Homo sapiens
  ENSP00000238682
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 37123 - protein, 567 aa, Homo sapiens
  ENSP00000295754
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 37124 - protein, 592 aa, Homo sapiens
  ENSP00000351905
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 37125 - protein, 528 aa, Homo sapiens
  ENSP00000370571
MPTPDATTPQAKGFRRAVSELDAKQAEAIMVRGQGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 37126 - protein, 524 aa, Homo sapiens
  ENSP00000370567
MPTPDATTPQAKGFRRAVSELDAKQAEAIMGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 37127 - protein, 497 aa, Homo sapiens
  ENSP00000325951
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 37128 - protein, 44 aa, Homo sapiens
  ENSP00000325831
MPTPDATTPQAKGFRRAVSELDAKQAEAIMGHQALGAVPSCEGV

SEQ ID NO: 37129 - protein, 45 aa, Homo sapiens
  ENSP00000403440
  MOD_RES (1)..(1): Any amino acid
XDLDHPGFSDQVYRQRRKLIAEIAFQYRHGDPIPRVEYTAEEIAT

SEQ ID NO: 37130 - protein, 116 aa, Homo sapiens
  ENSP00000403546
  MOD_RES (1)..(1): Any amino acid
XDLDHPGFSDQVYRQRRKLIAEIAFQYRHGDPIPRVEYTAEEIATWDCCHELLGHVPMLADRTFAQFSQDIGLASLGASDEEIEKLSTLYWFTVEFGLCKQNGEVKAYGAGLLSSY

SEQ ID NO: 37131 - protein, 48 aa, Homo sapiens
  ENSP00000370560
MPTPDATTPQAKGFRRAVSELDAKQAEAIMVRGQGHQALGAVPSCEGV

SEQ ID NO: 37132 - protein, 403 aa, Homo sapiens
  ENSP00000328814
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 37133 - protein, 1172 aa, Homo sapiens
  ENSP00000355751
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 37134 - protein, 83 aa, Homo sapiens
  ENSP00000398928
MVWRLVLLALWVWPSTQAGHQDKDTTFDLFSISNINRKTIGAKQFRGPDPGVPAYRFVRFDYIPPVNADDLSKITKIMRQKEG

SEQ ID NO: 37135 - protein, 1172 aa, Homo sapiens; identical to SEQ ID NO: 37133
  ENSP00000482784

SEQ ID NO: 37136 - protein, 961 aa, Homo sapiens
  ENSP00000339730
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 37137 - protein, 870 aa, Homo sapiens
  ENSP00000422298
MGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTIAECQACGPLKFQSPTPSTVVPPAPPAPPTRPPRRCDSNPCFRGVQCTDSRDGFQCGPCPEGYTGNGITCIDVDECKYHPCYPGVHCINLSPGFRCDACPVGFTGPMVQGVGISFAKSNKQVCTDIDECRNGACVPNSICVNTLGSYRCGPCKPGYTGDQIRGCKAERNCRNPELNPCSVNAQCIEERQGDVTCVCGVGWAGDGYICGKDVDIDSYPDEELPCSARNCKKDNCKYVPNSGQEDADRDGIGDACDEDADGDGILNEQDNCVLIHNVDQRNSDKDIFGDACDNCLSVLNNDQKDTDGDGRGDACDDDMDGDGIKNILDNCPKFPNRDQRDKDGDGVGDACDSCPDVSNPNQSDVDNDLVGDSCDTNQDSDGDGHQDSTDNCPTVINSAQLDTDKDGIGDECDDDDDNDGIPDLVPPGPDNCRLVPNPAQEDSNSDGVGDICESDFDQDQVIDRIDVCPENAEVTLTDFRAYQTVVLDPEGDAQIDPNWVVLNQGMEIVQTMNSDPGLAVGYTAFNGVDFEGTFHVNTQTDDDYAGFIFGYQDSSSFYVVMWKQTEQTYWQATPFRAVAEPGIQLKAVKSKTGPGEHLRNSLWHTGDTSDQVRLLWKDSRNVGWKDKVSYRWFLQHRPQVGYIRVRFYEGSELVADSGVTIDTTMRGGRLGVFCFSQENIIWSNLKYRCNDTIPEDFQEFQTQNFDRFDN

SEQ ID NO: 37138 - protein, 50 aa, Homo sapiens
  ENSP00000473349
MFPKSNLTVTCWVWRSMRKLFLLLSLLLSHAAHLEGKKDNQFIWKPGLAK

SEQ ID NO: 37139 - protein, 1606 aa, Homo sapiens
  ENSP00000387145
MFPKSNLTVTCWVWRSMRKLFLLLSLLLSHAAHLEGKKDNQFIWKPGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 37140 - protein, 1577 aa, Homo sapiens
  ENSP00000413841
MHNTADEVVLYHKLAGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQAQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 37141 - protein, 1608 aa, Homo sapiens
  ENSP00000272643
MFPKSNLTVTCWVWRSMRKLFLLLSLLLSHAAHLEGKKDNQFIWKPGPWGRCTGDCGPGGVQSRAVWCFHVDGWTSHLSNCGESNRPPKERSCFRVCDWHSDLFQWEVSDWHHCVLVPYARGEVKPRTAECVTAQHGLQHRMVRCIQKLNRTVVANEICEHFALQPPTEQACLIPCPRDCVVSEFLPWSNCSKGCGKKLQHRTRAVIAPPLFGGLQCPNLTESRACDAPISCPLGEEEYTFSLKVGPWSKCRLPHLKEINPSGRTVLDFNSDSNERVTFKHQSYKAHHHSKSWAIEIGYQTRQVSCTRSDGQNAMLSLCLQDSFPLTVQSCIMPKDCETSQWSSWSPCSKTCRSGSLLPGFRSRSRNVKHMAIGGGKECPELLEKEACIVEGELLQQCPRYSWRTSEWKECQVSLLLEQQDPHWHVTGPVCGGGIQTREVYCAQSVPAAAALRAKEVSRPVEKALCVGPAPLPSQLCNIPCSTDCIVSSWSAWGLCIHENCHDPQGKKGFRTRQRHVLMESTGPAGHCPHLVESVPCEDPMCYRWLASEGICFPDHGKCGLGHRILKAVCQNDRGEDVSGSLCPVPPPPERKSCEIPCRMDCVLSEWTEWSSCSQSCSNKNSDGKQTRSRTILALAGEGGKPCPPSQALQEHRLCNDHSCMQLHWETSPWGPCSEDTLVTALNATIGWNGEATCGVGIQTRRVFCVKSHVGQVMTKRCPDSTRPETVRPCFLPCKKDCIVTAFSEWTPCPRMCQAGNATVKQSRYRIIIQEAANGGQECPDTLYEERECEDVSLCPVYRWKPQKWSPCILVPESVWQGITGSSEACGKGLQTRAVSCISDDNRSAEMMECLKQTNGMPLLVQECTVPCREDCTFTAWSKFTPCSTNCEATKSRRRQLTGKSRKKEKCQDSDLYPLVETELCPCDEFISQPYGNWSDCILPEGRREPHRGLRVQADSKECGEGLRFRAVACSDKNGRPVDPSFCSSSGYIQEKCVIPCPFDCKLSDWSSWGSCSSSCGIGVRIRSKWLKEKPYNGGRPCPKLDLKNQGQVHEAVPCYSECNQYSWVVEHWSSCKINNELRSLRCGGGTQSRKIRCVNTADGEGGAVDSNLCNQDEIPPETQSCSLMCPNECVMSEWGLWSKCPQSCDPHTMQRRTRHLLRPSLNSRTCAEDSQVQPCLLNENCFQFQYNLTEWSTCQLSENAPCGQGVRTRLLSCVCSDGKPVSMDQCEQHNLEKPQRMSIPCLVECVVNCQLSGWTAWTECSQTCGHGGRMSRTRFIIMPTQGEGRPCPTELTQEKTCPVTPCYSWVLGNWSACKLEGGDCGEGVQIRSLSCMVHSGSISHAAGRVEDALCGEMPFQDSILKQLCSVPCPGDCHLTEWSEWSTCELTCIDGRSFETVGRQSRSRTFIIQSFENQDSCPQQVLETRPCTGGKCYHYTWKASLWNNNERTVWCQRSDGVNVTGGCSPQARPAAIRQCIPACRKPFSYCTQGGVCGCEKGYTEIMKSNGFLDYCMKVPGSEDKKADVKNLSGKNRPVNSKIHDIFKGWSLQPLDPDGRVKIWVYGVSGGAFLIMIFLIFTSYLVCKKPKPHQSTPPQQKPLTLAYDGDLDM

SEQ ID NO: 37142 - protein, 225 aa, Homo sapiens
  ENSP00000376374
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMVDVQFVRMMKRFIPLAELKSYHQAHKATGGPLKNMVLFTRQRLSIQPLTQEEFDFVLSLEEKEPS

SEQ ID NO: 37143 - protein, 225 aa, Homo sapiens; identical to SEQ ID NO: 37142
  ENSP00000341657

SEQ ID NO: 37144 - protein, 225 aa, Homo sapiens; identical to SEQ ID NO: 37142
  ENSP00000376373

SEQ ID NO: 37145 - protein, 166 aa, Homo sapiens
  ENSP00000341452
MSRPRKRLAGTSGSDKGLSGKRTKTENSGEALAKVEDSNPQKTSATKNCLKNLSSHWLMKSEPESRLEKGVDVKFSIEDLKAQPKQTTCWDGVRNYQARNFLRAMKLGEEAFFYHSNCKEPGIAGLMKIVKEAYPDHTQFEKNNPHYDPSSKEDNPKWSMKSLILF

SEQ ID NO: 37146 - protein, 211 aa, Homo sapiens
  ENSP00000266085
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 37147 - protein, 657 aa, Homo sapiens
  ENSP00000418757
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 37148 - protein, 657 aa, Homo sapiens; identical to SEQ ID NO: 37147
  ENSP00000295924

SEQ ID NO: 37149 - protein, 657 aa, Homo sapiens; identical to SEQ ID NO: 37147
  ENSP00000420612

SEQ ID NO: 37150 - protein, 506 aa, Homo sapiens
  ENSP00000419982
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEK

SEQ ID NO: 37151 - protein, 654 aa, Homo sapiens
  ENSP00000418829
MEMETTEPEPDCVVQPPSPPDDFSCQMRLSEKITPLKTCFKKKDQKRLGTGTLRSLRPILNTLLESGSLDGVFRSRNQSTDENSLHEPMMKKAMEINSSCPPAENNMSVLIPDRTNVGDQIPEAHPSTEAPERVVPIQDHSFPSETLSGTVADSTPAHFQTDLLHPVSSDVPTSPDCLDKVIDYVPGIFQENSFTIQYILDTSDKLSTELFQDKSEEASLDLVFELVNQLQYHTHQENGIEICMDFLQGTCIYGRDCLKHHTVLPYHWQIKRTTTQKWQSVFNDSQEHLERFYCNPENDRMRMKYGGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNT

SEQ ID NO: 37152 - protein, 360 aa, Homo sapiens
  ENSP00000420141
  MOD_RES (1)..(1): Any amino acid
XTNKLEQPRGQEFWADLNAMNVYETTEFDQLRRLSTPPSSNVNSIYHTVWKFFCRDHFGWREYPESVIRLIEEANSRGLKEVRFMMWNNHYILHNSFFRREIKRRPLFRSCFILLPYLQTLGGVPTQAPPPLEATSSSQIICPDGVTSANFYPETWVYMHPSQDFIQVPVSAEDKSYRIIYNLFHKTVPEFKYRILQILRVQNQFLWEKYKRKKEYMNRKMFGRDRIINERHLFHGTSQDVVDGICKHNFDPRVCGKHATMFGQGSYFAKKASYSHNFSKKSSKGVHFMFLAKVLTGRYTMGSHGMRRPPPVNPGSVTSDLYDSCVDNFFEPQIFVIFNDDQSYPYFVIQYEEVSNTVSI

SEQ ID NO: 37153 - protein, 657 aa, Homo sapiens; identical to SEQ ID NO: 37147
  ENSP00000438345

SEQ ID NO: 37154 - protein, 247 aa, Homo sapiens
  ENSP00000292090
MPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 37155 - protein, 53 aa, Homo sapiens
  ENSP00000468670
  MOD_RES (1)..(1): Any amino acid
XGGGVLTLLVEVSNIFLTIRMMMKISNAQDHLLYRVNKGPWAPSCWVSCSCWT

SEQ ID NO: 37156 - protein, 200 aa, Homo sapiens
  ENSP00000378391
MGYSAVPKCPPRGRGRDSVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 37157 - protein, 147 aa, Homo sapiens
  ENSP00000466264
MLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMI

SEQ ID NO: 37158 - protein, 773 aa, Homo sapiens
  ENSP00000365735
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 37159 - protein, 101 aa, Homo sapiens
  ENSP00000417906
MIRDLSKMYPQTRHPAPHQPAQPFKFTISESCDRIKEEFQFLQAQYHSLKLECEKLASEKTEMQRHYVMYYEMSYGLNIEMHKQVSYFFITILNDSNTGTL

SEQ ID NO: 37160 - protein, 90 aa, Homo sapiens
  ENSP00000417245
MIRDLSKMYPQTRHPAPHQPAQPFKFTISESCDRIKEEFQFLQAQYHSLKLECEKLASEKTEMQRHYVMYYEMSYGLNIEMHKQRLFFTN

SEQ ID NO: 37161 - protein, 224 aa, Homo sapiens
  ENSP00000415423
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGEKKNKSDTPGSLKQQQLQAQHLSHGHGLPVPLTPHPSGLQPPAIPPIGSSAGLLALSSALGGQSHLPIKDEKKHHDNDHQRGEQRLHQELFSIP

SEQ ID NO: 37162 - protein, 128 aa, Homo sapiens
  ENSP00000397822
MIRDLSKMYPQTRHPAPHQPAQPFKFTISESCDRIKEEFQFLQAQYHSLKLECEKLASEKTEMQRHYVMAEIVKRLNAICAQVIPFLSQEHQQQVVQAVERAKQVTMAELNAIIGQQQLQAQHLSHGH

SEQ ID NO: 37163 - protein, 805 aa, Homo sapiens
  ENSP00000365720
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 37164 - protein, 259 aa, Homo sapiens
  ENSP00000417715
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKQNYLLLIMDEIGDQRGRTFWVPVSLNPDFKRHSPAMLVLCASTELFSIPISQFPRC

SEQ ID NO: 37165 - protein, 748 aa, Homo sapiens
  ENSP00000265284
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 37166 - protein, 195 aa, Homo sapiens
  ENSP00000412567
MARVPPTGQFRFRAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQR

SEQ ID NO: 37167 - protein, 322 aa, Homo sapiens
  ENSP00000409313
APHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNEKRDMGKLSETRLSEDEQCTLGLQRWFCRLWFMNEKSTTPVSKSNTPTPRTDAPTPGSNSTPGLRPVPGKPPGVDPL

SEQ ID NO: 37168 - protein, 239 aa, Homo sapiens
  ENSP00000417844
QQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYDSDGEKSDDNLVVDVSNENEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSP

SEQ ID NO: 37169 - protein, 165 aa, Homo sapiens
  ENSP00000418409
SSSVSPSASFRGAEKHRNSADYSSESKKQKTEEKEIAARYNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPP

SEQ ID NO: 37170 - protein, 343 aa, Homo sapiens
  ENSP00000417102
  MOD_RES (1)..(1): Any amino acid
XASFRGAEKHRNSADYSSESKKQKTEEKEIAARYDSDGEKSDDNLVVDVSNEDPSSPRGSPAHSPRENGLDKTRLLKKDAPISPASIASSSSTPSSKSKELSLNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPTKCFYHLRAFPGNELEMELPRDTHRAYSFHVSADGQMQPVPFPPDALIGPGIPRHARQINTLNHGEVVCAVTISNPTRHVYTGGKGCVKVWDISHPGNKSPVSQL

SEQ ID NO: 37171 - protein, 211 aa, Homo sapiens
  ENSP00000400334
  MOD_RES (1)..(1): Any amino acid
XSPAHSPRENGLDKTRLLKKDAPISPASIASSSSTPSSKSKELSLKRDMGKLSETRLSEDEQCTLGLQRWFCRLWFMNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGK

SEQ ID NO: 37172 - protein, 704 aa, Homo sapiens
  ENSP00000365727
MIRDLSKMYPQTRHPAPHQPAQPFKFTISESCDRIKEEFQFLQAQYHSLKLECEKLASEKTEMQRHYVMYYEMSYGLNIEMHKQAEIVKRLNAICAQVIPFLSQEHQQQVVQAVERAKQVTMAELNAIIGQQLQAQHLSHGHGLPVPLTPHPSGLQPPAIPPIGSSAGLLALSSALGGQSHLPIKDEKKHHDNDHQRDRDSIKSSSVSPSASFRGAEKHRNSADYSSESKKQKTEEKEIAARYNEKSTTPVSKSNTPTPRTDAPTPGSNSTPGLRPVPGKPPGVDPLASSLRTPMAVPCPYPTPFGIVPHAGMNGELTSPGAAYAGLHNISPQMSAAAAAAAAAAAYGRSPVVGFDPHHHMRVPAIPPNLTGIPGGKPAYSFHVSADGQMQPVPFPPDALIGPGIPRHARQINTLNHGEVVCAVTISNPTRHVYTGGKGCVKVWDISHPGNKSPVSQLDCLNRDNYIRSCRLLPDGRTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMENSNVEVLHVTKPDKYQLHLHESCVLSLKFAHCGKWFVSTGKDNLLNAWRTPYGASIFQSKESSSVLSCDISVDDKYIVTGSGDKKATVYEVIY

SEQ ID NO: 37173 - protein, 572 aa, Homo sapiens
  ENSP00000246112
MTSRDQPRPKGPPKSTSPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 37174 - protein, 154 aa, Homo sapiens
  ENSP00000411783
MTSRDQPRPKGPPKSTSPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWF

SEQ ID NO: 37175 - protein, 45 aa, Homo sapiens
  ENSP00000467126
MTSRDQPRPKGPPKSTSPCPGISNSESSPTLNYQGILNRLKQFPR

SEQ ID NO: 37176 - protein, 449 aa, Homo sapiens
  ENSP00000406893
MATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 37177 - protein, 1013 aa, Homo sapiens
  ENSP00000061240
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 37178 - protein, 130 aa, Homo sapiens
  ENSP00000422692
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGISMFKVADA

SEQ ID NO: 37179 - protein, 1036 aa, Homo sapiens
  ENSP00000426082
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEQEHQENPGIASKARESLILIWKPIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 37180 - protein, 57 aa, Homo sapiens
  ENSP00000421732
MGLGTLSPRMLVWLVASGIVFYGELWVCAGLDYDYTFDGNEEDKTETIDYKDPCKAD

SEQ ID NO: 37181 - protein, 392 aa, Homo sapiens
  ENSP00000422937
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKVVFSLC

SEQ ID NO: 37182 - protein, 110 aa, Homo sapiens
  ENSP00000423748
MSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPC

SEQ ID NO: 37183 - protein, 904 aa, Homo sapiens
  ENSP00000296795
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 37184 - protein, 351 aa, Homo sapiens
  ENSP00000423386
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVWLKCLEHLNMEDNDIPGIKSNMFTGLINLKYLSLSNSFTSLRTLTNETFVSLAHSPLHILNLT

SEQ ID NO: 37185 - protein, 627 aa, Homo sapiens
  ENSP00000423684
MLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 37186 - protein, 799 aa, Homo sapiens
  ENSP00000377997
MELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 37187 - protein, 839 aa, Homo sapiens
  ENSP00000363089
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 37188 - protein, 171 aa, Homo sapiens
  ENSP00000391674
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 37189 - protein, 214 aa, Homo sapiens
  ENSP00000416050
MVLGGCPVSYLLLCGQAALLLGNLLLLHCVSRSHSQNATAEPELTSAGAAQPEGPGGAASWEYGDPHSPVILCSYLPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 37190 - protein, 171 aa, Homo sapiens; identical to SEQ ID NO: 37188
  ENSP00000380260

SEQ ID NO: 37191 - protein, 120 aa, Homo sapiens
  ENSP00000428394
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCF

SEQ ID NO: 37192 - protein, 62 aa, Homo sapiens
  ENSP00000430685
MKKCLLPVLITCMQTAICKDRMMMIMILLVNYRPDEFIECEDPVDHVGNATASQELGYGCLK

SEQ ID NO: 37193 - protein, 45 aa, Homo sapiens
  ENSP00000428203
MKKCLLPVLITCMQTAICKDRMMMIMILLVNYRPDEFIECEDPVD

SEQ ID NO: 37194 - protein, 202 aa, Homo sapiens
  ENSP00000304277
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 37195 - protein, 117 aa, Homo sapiens
  ENSP00000417084
MLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQVRTCMKMS

SEQ ID NO: 37196 - protein, 101 aa, Homo sapiens
  ENSP00000419426
MCYGKCARCIGHSLVGLALLCIAANILLYFPNGETKYASENHLSRFVWFFSGIVGGGLLMLLPAFVFIGLEQDDCCGCCGHENCGKRCAVPSGYLHMVRVH

SEQ ID NO: 37197 - protein, 103 aa, Homo sapiens
  ENSP00000418025
MCYGKCARCIGHSLVGLALLCIAANILLYFPNGETKYASENHLSRFVWFFSGIVGGGLLMLLPAFVFIGLEQDDCCGCCGHENCGKRCAVGPPALVVKMTPKM

SEQ ID NO: 37198 - protein, 760 aa, Homo sapiens
  ENSP00000297784
MSPKKVQIKVEEKEDETEESSSEEEEEVEDKLPRRESLRPKRKRTRDVINEDDPEPEPEDEETRKAREKERRRRLKRGAEEEEIDEEELERLKAELDEKRQIIATVKCKPWKMEKKIEVLKEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMIWMGSFFAPSLPGINILRLHTSMYFQCWAVMCCNVPEARVFKASRSNNFYLGMLLLILFLSTMPVLYMIVSLPPSFDCGPFSGKNRMFEVIGETLEHDFPSWMAKILRQLSNPGLVIAVILVMVLAIYYLNATAKGQKAANLDLKKKMKMQALENKMRNKKMAAARAAAAAGRQ

SEQ ID NO: 37199 - protein, 760 aa, Homo sapiens; identical to SEQ ID NO: 37198
  ENSP00000341433

SEQ ID NO: 37200 - protein, 758 aa, Homo sapiens
  ENSP00000455041
MSESSGSALQPGRPSRQPAVHPENLSLDSSCFSSPPVNFLQELPSYRSIARRRTTVHSRDKQSGTLLKPTDSYSSQLEDRIAENLSSHSLRNYALNISEKRRLRDIQETQMKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLVRKHSSRGSWLGTFTQDTARKVLFSWEGVKLLQPSLTTTSPKLCLEAQPRPASLIH

SEQ ID NO: 37201 - protein, 723 aa, Homo sapiens
  ENSP00000304710
MSESSGSALQPGRPSRQPAVHPENLSLDSSCFSSPPVNFLQELPSYRSIARRRTTVHSRDKQSGTLLKPTDSYSSQLEDRIAENLSSHSLRNYALNISEKRRLRDIQETQMKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 37202 - protein, 613 aa, Homo sapiens
  ENSP00000397081
MKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 37203 - protein, 134 aa, Homo sapiens
  ENSP00000395328
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQRSLFA

SEQ ID NO: 37204 - protein, 134 aa, Homo sapiens; identical to SEQ ID NO: 37203
  ENSP00000465638

SEQ ID NO: 37205 - protein, 129 aa, Homo sapiens
  ENSP00000459290
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQ

SEQ ID NO: 37206 - protein, 575 aa, Homo sapiens
  ENSP00000324651
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 37207 - protein, 575 aa, Homo sapiens; identical to SEQ ID NO: 37206
  ENSP00000376838

SEQ ID NO: 37208 - protein, 89 aa, Homo sapiens
  ENSP00000422072
MVTAPHSSTRHTSVVMLTPNPDGPPSQAAAPMATPTPRAEGHPPTHTISTIAATVTAPHSESSLSTGPAPAAMATTSSKPEGRPRGQAA

SEQ ID NO: 37209 - protein, 121 aa, Homo sapiens
  ENSP00000427447
MVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPG

SEQ ID NO: 37210 - protein, 148 aa, Homo sapiens
  ENSP00000426301
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPG

SEQ ID NO: 37211 - protein, 71 aa, Homo sapiens
  ENSP00000422196
MKRSLQALYCQLLSFLLILALTEALAFAIQEPSPRESLQVLPSGTPPGTMVTAPHSSTRHTSVVMLTPNPD

SEQ ID NO: 37212 - protein, 105 aa, Homo sapiens
  ENSP00000424897
MKRSLQALYCQLLTVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 37213 - protein, 488 aa, Homo sapiens
  ENSP00000423338
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSDPIT

SEQ ID NO: 37214 - protein, 153 aa, Homo sapiens
  ENSP00000421486
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRP

SEQ ID NO: 37215 - protein, 189 aa, Homo sapiens
  ENSP00000355285
MGLGARGAWAALLLGTLQVLALLGAAHESAAMAETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 37216 - protein, 208 aa, Homo sapiens
  ENSP00000381204
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 37217 - protein, 120 aa, Homo sapiens
  ENSP00000435331
MKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 37218 - protein, 120 aa, Homo sapiens; identical to SEQ ID NO: 37217
  ENSP00000434976

SEQ ID NO: 37219 - protein, 22 aa, Homo sapiens
  ENSP00000433695
MKPTAASNTTTPGMVSTNMTST

SEQ ID NO: 37220 - protein, 46 aa, Homo sapiens
  ENSP00000435842
MSSISVVNHQETLQHVPSDHTNETSNSTVKPPTSVASDSSNTTVTT

SEQ ID NO: 37221 - protein, 219 aa, Homo sapiens
  ENSP00000429775
MSEQEAQAPGGRGLPPDMLAEQVELWWSQQPRRSALCFVVAVGLVAGCGAGGVALLSTTSSRSGEWRLATGTVLCLLALLVLVKQLMSSAVQDMNCIRQAHHVALLRSGGGADALVVLLSGLVLLVTGLTLAGLAAAPAPARPLAAMLSVGIALAALGSLLLLGLLLYQVGVSGHCPSICMATPSTHSGHGGHGSIFSISGQLSAGRRHETTSSIASLI

SEQ ID NO: 37222 - protein, 219 aa, Homo sapiens; identical to SEQ ID NO: 37221
  ENSP00000429275

SEQ ID NO: 37223 - protein, 15 aa, Homo sapiens
  ENSP00000428627
MSEQEAQAPGGRGLP

SEQ ID NO: 37224 - protein, 435 aa, Homo sapiens
  ENSP00000413163
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVEVADFDFSPMSDKNPEPPSGVRCCCQMCCGPFLLETPSEYLEIVRENHGLLPPLYKSVKTYTV

SEQ ID NO: 37225 - protein, 423 aa, Homo sapiens
  ENSP00000341256
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 37226 - protein, 339 aa, Homo sapiens
  ENSP00000390200
MEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 37227 - protein, 321 aa, Homo sapiens
  ENSP00000330262
MAQAVWSRLGRILWLACLLPWAPAGVAAEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVENPEPPSGVRCCCQMCCGPFLLETPSEYLEIVRENHGLLPPLYKSVKTYTV

SEQ ID NO: 37228 - protein, 46 aa, Homo sapiens
  ENSP00000389379
MEKGLSSTIRVVGHVPGEFPVSVWVTAADCWMCQPVARGFVVLPIT

SEQ ID NO: 37229 - protein, 1078 aa, Homo sapiens
  ENSP00000299308
MFGAASRMDTTAVCTGGVTESRGIVDSLQKFSSLPAYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRIKAAAGVKITAVRVSSEDQWAVQEEIDNGSTQTSATLTCMGHRPDTQSRVNGSFYEILQVDFGIDNSSDLAGAQQITWQVEYPIEDSMSELVVSEIFVSQTTFVGIVPLAMDTEVLNTAILTGKPVSVPVKVVGVQEDGSVVDVSESVECKSADEDVIKVSNNCDSIFVNGKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 37230 - protein, 590 aa, Homo sapiens
  ENSP00000482788
MKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 37231 - protein, 1108 aa, Homo sapiens
  ENSP00000410852
MRSEGAAPGPAAPLCGALSLLLGALLGKVIEGHGVTDNIQRFSSLPPYLPVSYHILRAETSFFLKEANQDLLRNSSLQARVESFFTYKTRQPPVLNASYGPFSVEKVVPLDLMLTSNFLGPTNKFSFDWKLKAHILRDKVYLSRPKVQVLFHIMGRDWDDHGAGEKLPCLRVFAFRETREVRGSCRLKGDLGLCVAELELLSSWFSAPTVGAGRKKSMDQPEGTPVELYYTVHPGNERGDCAGGDFRKGNAIRPGKDGLEETTSHLQRIGTVGLYRAQDSAQLSELRLDGNVVIWLPSRPVKQGEVVTAYVTISSNSSVDLFILRAKVKKGVNILSAQTREPRQWGVKQEVGSGGKHVTATVACQRLGPSPRNRSSSLFNEVVQMNFEIASFSSLSGTQPITWQVEYPRKGTTDIAVSEIFVSQKDLVGIVPLAMDTEILNTAVLTGKTVAMPIKVVSVEENSAVMDISESVECKSTDEDVIKVSERCDYIFVNGKEIKGKMDAVVNFTYQYLSAPLCVTVWVPRLPLQIEVSDTELSQIKGWRVPIVTNKRPTRESEDEDEEERRGRGCALQYQHATVRVLTQFVSEGAGPWGQPNYLLSPNWQFDITHLVADFMKLEEPHVATLQDSRVLVGREVGMTTIQVLSPLSDSILAEKTITVLDDKVSVTDLAIQLVAGLSVALYPNAENSKAVTAVVTAEEVLRTPKQEAVFSTWLQFSDGSVTPLDIYDTKDFSLAATSQDEAVVSVPQPRSPRWPVVVAEGEGQGPLIRVDMTIAEACQKSKRKSILAVGVGNVRVKFGQNDADSSPGGDYEEDEIKNHASDRRQKGQHHERTGQDGHLYGSSPVEREEGALRRATTTARSLLDNKVVKNSRADGGRLAGEGQLQNIPIDFTNFPAHVDLPKAGSGLEENDLVQTPRGLSDLEIGMYALLGVFCLAILVFLINCATFALKYRHKQVPLEGQASMTHSHDWVWLGNEAELLESMGDAPPPQDEHTTIIDRGPGACEESNHLLLNGGSHKHVQSQIHRSADSGGRQGREQKQDPLHSPTSKRKKVKFTTFTTIPPDDSCPTVNSIVSSNDEDIKWVCQDVAVGAPKELRNYLEKLKDKA

SEQ ID NO: 37232 - protein, 637 aa, Homo sapiens
  ENSP00000374092
MQRDESSPFPPLFSLTSSQVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 37233 - protein, 1099 aa, Homo sapiens
  ENSP00000408581
MCPSEMGTLWHHWSPVLISLAALFSKVTEGRGILESIQRFSLLPTYLPVTYHINNADVSFFLKEANQDIMRNSSLQSRVESFLIYKSRRLPVLNASYGPFSIEQVVPQDLMLPSNPFGFTNKFSLNWKLKAHILRDKVYLSRPKVQVLFHIMGRDWDDRSAGEKLPCLRVFAFRETREVRGSCRLQGDLGLCVAELELLSSWFSPPTVVAGRRKSVDQPEGTPVELYYTVHPGGERGDCVREDARRSNGIRTGHSDIDESGPPLQRIGSIFLYQTHRKPSLRELRLDNSVAIHYIPKTVRKGDVLTFPVSISRNSTEDRFTLRAKVKKGVNIIGVRASSPSIWDVKERTDYTGKYAPAVIVCQKKAAGSENSADGASYEVMQIDVEVEEPGDLPATQLVTWQVEYPGEITSDLGVSKIYVSPKDLIGVVPLAMEAEILNTAILTGKTVAVPVKVVSVEDDGTVTELLESVECRSSDEDVIKVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 37234 - protein, 984 aa, Homo sapiens
  ENSP00000316532
MAPGMSGRGGAALLCLSALLAHASGRSHPASPSPPGPQASPVLPVSYRLSHTRLAFFLREARPPSPAVANSSLQRSEPFVVFQTKELPVLNVSLGPFSTSQVVARELLQPSSTLDIPERLTVNWKVRAFIVRSHVPASQPVVQVLFYVAGRDWDDFGVTERLPCVRLHAFRDAREHPLLRIGSISLFRPPPRRTLQEHRLDSNLMIRLPDRPLKPGEVLSILLYLAPNSSSPSSPSVEHFTLRVKAKKGVTLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDIIKVSSSCDYVFVSGKESRGSMNARVTFRYDVLNAPLEMTVWVPKLPLHIELSDARLSQVKGWRVPILPDRRSVRESEDEDEEEEERRQSASRGCTLQYQHATLQVFTQFHTTSSEGTDQVVTMLGPDWLVEVTDLVSDFMRVGDPRVAHMVDSSTLAGLEPGTTPFKVVSPLTEAVLGETLLTVTEEKVSITQLQAQVVASLALSLRPSPGSSHTILATTAAQQTLSFLKQEALLSLWLSYSDGTTAPLSLYSPRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYALLGVFCLAILVFLINCIVFVLRYRHKRIPPEGQTSMDHSHHWVFLGNGQPLRVQGELSPPAGNPLETVPAFCHGDHHSSGSSQTSVQSQVHGRGDGSSGGSARDQAEDPASSPTSKRKRVKFTTFTTLPSEELAYDSVPAGEEDEEEEEDLGWGCPDVAGPTRPTAPPDLHNYMRRIKEIA

SEQ ID NO: 37235 - protein, 1074 aa, Homo sapiens
  ENSP00000487800
MAPGMSGRGGAALLCLSALLAHASGRSHPASPSPPGPQASPVLPVSYRLSHTRLAFFLREARPPSPAVANSSLQRSEPFVVFQTKELPVLNVSLGPFSTSQVVARELLQPSSTLDIPERLTVNWKVRAFIVRSHVPASQPVVQVLFYVAGRDWDDFGVTERLPCVRLHAFRDAREVKSSCRLSGGLATCLVRAELPLAWFGPPAPAAPPTARRKSPDGLEPEATGESQQAELYYTLHAPDASGGCGGSRRGAGPGVGARAESPTQHPLLRIGSISLFRPPPRRTLQEHRLDSNLMIRLPDRPLKPGEVLSILLYLAPNSSSPSSPSVEHFTLRVKAKKGVTLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDIIKVSSSCDYVFVSGKESRGSMNARVTFRYDVLNAPLEMTVWVPKLPLHIELSDARLSQVKGWRVPILPDRRSVRESEDEDEEEEERRQSASRGCTLQYQHATLQVFTQFHTTSSEGTDQVVTMLGPDWLVEVTDLVSDFMRVGDPRVAHMVDSSTLAGLEPGTTPFKVVSPLTEAVLGETLLTVTEEKVSITQLQAQVVASLALSLRPSPGSSHTILATTAAQQTLSFLKQEALLSLWLSYSDGTTAPLSLYSPRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYALLGVFCLAILVFLINCIVFVLRYRHKRIPPEGQTSMDHSHHWVFLGNGQPLRVQGELSPPAGNPLETVPAFCHGDHHSSGSSQTSVQSQVHGRGDGSSGGSARDQAEDPASSPTSKRKRVKFTTFTTLPSEELAYDSVPAGEEDEEEEEDLGWGCPDVAGPTRPTAPPDLHNYMRRIKEIA

SEQ ID NO: 37236 - protein, 77 aa, Homo sapiens
  ENSP00000425266
MSNNGADLTFGYISCFVAILLFGSNFVPLKKFDTGDGMFLQWVLCAAIWLVALVVNLILHCPKFWPFAMLGGCIWAT

SEQ ID NO: 37237 - protein, 87 aa, Homo sapiens
  ENSP00000421289
MSNNGADLTFGYISCFVAILLFGSNFVPLKKFDTGDGMFLQWVLCAAIWLVALVVNLILHCPKFWPFAMLGGCIWATGNIAVVPIIK

SEQ ID NO: 37238 - protein, 10 aa, Homo sapiens
  ENSP00000422255
MSNNGADLTF

SEQ ID NO: 37239 - protein, 167 aa, Homo sapiens
  ENSP00000422297
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVI

SEQ ID NO: 37240 - protein, 345 aa, Homo sapiens
  ENSP00000296529
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVINTTQDPCSWVDKLSTVHHRIVGCSLAVISGVLYGSTFVPIIYIKDHSKRNDSIYAGASQYDLDYVFAHFSGIFLTSTVYFLAYCIAMKNSPKLYPEAVLPGFLSGVLWAIATCCWFIANHSLSAVVSFPIITAGPGFIAAMWGIFMFKEIKGLQNYLLMILAFCIILTGALCTAFSKI

SEQ ID NO: 37241 - protein, 87 aa, Homo sapiens; identical to SEQ ID NO: 37237
  ENSP00000424659

SEQ ID NO: 37242 - protein, 137 aa, Homo sapiens
  ENSP00000422082
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVV

SEQ ID NO: 37243 - protein, 73 aa, Homo sapiens
  ENSP00000425815
MSNNGADLTFGYISCFVAILLFGSNFVPLKKFDTGDGNYFSLIVNVILFLKMKFLFWSFKSIATKINHVDLDT

SEQ ID NO: 37244 - protein, 169 aa, Homo sapiens
  ENSP00000426211
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVSIV

SEQ ID NO: 37245 - protein, 110 aa, Homo sapiens
  ENSP00000420990
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASS

SEQ ID NO: 37246 - protein, 194 aa, Homo sapiens
  ENSP00000420930
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHGLQSCSDIWSTLWIYICANHLHQGPQQKK

SEQ ID NO: 37247 - protein, 77 aa, Homo sapiens; identical to SEQ ID NO: 37236
  ENSP00000425907

SEQ ID NO: 37248 - protein, 91 aa, Homo sapiens
  ENSP00000422899
MSNNGADLTFGYISCFVAILLFGSNFVPLKKFDTGDGMFLQWVLCAAIWLVALVVNLILHCPKFWPFAMLGGCIWATGNIAVVPIIKTIGL

SEQ ID NO: 37249 - protein, 249 aa, Homo sapiens
  ENSP00000420919
MDGKKCSVWMFLPLVFTLFTSAGLWIVYFIAVEDDKILPLNSAERKPGVKHAPYISIAGDDPPASCVFSQVMNMAAFLALVVAVLRFIQLKPKVLNPWLNISGLVALCLASFGMTLLGNFQLTNDEEIHNVGTSLTFGFGTLTCWIQAALTLKVNIKNEGRRVGIPRVILSASITLCVVLYFILMAQSIHMYAARVQWGLVMCFLSYFGTFAVEFRHYRYEIVCSEYQENFLSFSESLSEASEYQTDQV

SEQ ID NO: 37250 - protein, 249 aa, Homo sapiens; identical to SEQ ID NO: 37249
  ENSP00000403438

SEQ ID NO: 37251 - protein, 120 aa, Homo sapiens
  ENSP00000421812
MDGKKCSVWMFLPLVFTLFTSAGLWIVYFIAVEDDKILPLNSAERKPGVKHAPYISIAGDDPPASCVFSQVMNMAAFLALVVAVLRFIQLKPKVLNPWLNISGLVALCLASFGMTLLAHK

SEQ ID NO: 37252 - protein, 67 aa, Homo sapiens
  ENSP00000414988
MDGKKCSVWMFLPLVFTLFTSAGLWIVYFIAVEDDKILPLNSAERKPGVKHAPYISIAGDDPPASCV

SEQ ID NO: 37253 - protein, 289 aa, Homo sapiens
  ENSP00000281924
MEPAAGIQRRSSQGPTVPPPPRGHAPPAAAPGPAPLSSPVREPPQLEEERQVRISESGQFSDGLEDRGLLESSTRLKPHEAQNYRKKALWVSWFSIIVTLALAVAAFTVSVMRYSASAFGFAFDAILDVLSSAIVLWRYSNAAAVHSAHREYIACVILGVIFLLSSICIVVKAIHDLSTRLLPEVDDFLFSVSILSGILCSILAVLKFMLGKVLTSRALITDGFNSLVGGVMGFSILLSAEVFKHDSAVWYLDGSIGVLIGLTIFAYGVKLLIDMVPRVRQTRHYEMFE

SEQ ID NO: 37254 - protein, 113 aa, Homo sapiens
  ENSP00000424746
MSQPRTPEQALDTPGDCPPGRRDEDAGEGIQCSQRMLSFSDALLSIIATVMILPVTHTEISPEQFDRSVQRLLATRIAVYLMTFLIVTVAWAAHTRLFQVVGKTDDTLALLNL

SEQ ID NO: 37255 - protein, 504 aa, Homo sapiens
  ENSP00000264771
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 37256 - protein, 72 aa, Homo sapiens
  ENSP00000427218
MSQPRTPEQALDTPGDCPPGRRDEDAGEGIQCSQRMLSFSDALLSIIATVMILPVTHTEISPEQWTKAAPWK

SEQ ID NO: 37257 - protein, 179 aa, Homo sapiens
  ENSP00000425181
MSQPRTPEQALDTPGDCPPGRRDEDAGEGIQCSQRMLSFSDALLSIIATVMQFDRSVQRLLATRIAVYLMTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQG

SEQ ID NO: 37258 - protein, 212 aa, Homo sapiens
  ENSP00000425867
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKER

SEQ ID NO: 37259 - protein, 72 aa, Homo sapiens; identical to SEQ ID NO: 37256
  ENSP00000423751

SEQ ID NO: 37260 - protein, 162 aa, Homo sapiens
  ENSP00000421750
MTFLIVTVAWAAHTRLFQVVGKTDDTLALLNLFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPL

SEQ ID NO: 37261 - protein, 77 aa, Homo sapiens
  ENSP00000427626
MSQPRTPEQALDTPGDCPPGRRDEDAGEGIQCSQRMLSFSDALLSIIATVMILPVTHTEISPEQLPQQAGPLRSCSE

SEQ ID NO: 37262 - protein, 388 aa, Homo sapiens
  ENSP00000427039
MMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 37263 - protein, 422 aa, Homo sapiens
  ENSP00000423669
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 37264 - protein, 284 aa, Homo sapiens
  ENSP00000424208
MTFLIVTVAWAAHTRLFQVVGKTDDTLALLNLACMMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFA

SEQ ID NO: 37265 - protein, 133 aa, Homo sapiens
  ENSP00000425763
MSQPRTPEQALDTPGDCPPGRRDEDAGEGIQCSQRMLSFSDALLSIIATVMILPVTHTEISPEQQFDRSVQRLLATRIAVYLMTFLIVTVAWAAHTRLFQVVGKTDDTLALLNLACMMTITFLPYTFSLMVTF

SEQ ID NO: 37266 - protein, 388 aa, Homo sapiens; identical to SEQ ID NO: 37262
  ENSP00000485461

SEQ ID NO: 37267 - protein, 235 aa, Homo sapiens
  ENSP00000417626
MGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGKRDQKEMLEVSGI

SEQ ID NO: 37268 - protein, 235 aa, Homo sapiens; identical to SEQ ID NO: 37267
  ENSP00000004103

SEQ ID NO: 37269 - protein, 176 aa, Homo sapiens
  ENSP00000420818
MQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGKRDQKEMLEVSGI

SEQ ID NO: 37270 - protein, 177 aa, Homo sapiens
  ENSP00000417834
GSSRLLVASWVMQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGVSP

SEQ ID NO: 37271 - protein, 118 aa, Homo sapiens
  ENSP00000420081
MQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLC

SEQ ID NO: 37272 - protein, 270 aa, Homo sapiens
  ENSP00000419258
MTQNTVIVNGVAMASRPSQPTHVNVHIHQESALTQLLKAGGSLKKFLFHPGDTVPSTARIGYEQLALGVTQILLGVVSCVLGVCLSLGPWTVLSASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 37273 - protein, 270 aa, Homo sapiens; identical to SEQ ID NO: 37272
  ENSP00000318409

SEQ ID NO: 37274 - protein, 270 aa, Homo sapiens; identical to SEQ ID NO: 37272
  ENSP00000410269

SEQ ID NO: 37275 - protein, 270 aa, Homo sapiens; identical to SEQ ID NO: 37272
  ENSP00000397810

SEQ ID NO: 37276 - protein, 233 aa, Homo sapiens
  ENSP00000404831
MTQNTVIVNGVAMASRPSQPTHVNVHIHQESALTQLLKAGGSLKKFLFHPGDTVPSTARIGYEQLALGVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 37277 - protein, 270 aa, Homo sapiens; identical to SEQ ID NO: 37272
  ENSP00000413531

SEQ ID NO: 37278 - protein, 297 aa, Homo sapiens
  ENSP00000281961
MEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPLFATYSGLWRKCYFLGIDRDIDTLILKGIAQRCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 37279 - protein, 111 aa, Homo sapiens
  ENSP00000477622
MEPRALVTALSLGLSLCSLGLLVTAIFTDHWYETDPRRHKESCERSRAGADPPDQKNRLMPLSHLLGPLEEVLLPGHRPGHRHPHPERYCAAMHGHQVPLFSAHPLAKHSF

SEQ ID NO: 37280 - protein, 294 aa, Homo sapiens
  ENSP00000456594
MAAGRLLLYTGLSLALCALGMLAVAICSDHWYETDARKHRDRCKAFNTRRVDPGFIYNNNNNLPLRASRSRLDRWEGKLLRARNRRQLFAMSPADECSRQYNSTNMGLWRKCHRQGFDPEIAALIRKGEIERCTYIKYHYSSATIPRNLTFNITKTIRQDEWHALHLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 37281 - protein, 292 aa, Homo sapiens
  ENSP00000484025
MAAGRLLLYTGLSLALCALGMLAVAICSDHWYETDARKHRDRCKAFNTRRVDPGFIYNNNNNLPLRASRSRLDRWEGKLLRARNRRQLFAMSPADECSRQYNSTNMGLWRKCHRQGFDPEIAALIRKGEIERCTYIKYHYSSATIPRNLTFNVTKTLRCMYCMYLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 37282 - protein, 190 aa, Homo sapiens
  ENSP00000397763
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQGSLIDSHGVETPPGQS

SEQ ID NO: 37283 - protein, 78 aa, Homo sapiens
  ENSP00000452113
  MOD_RES (1)..(1): Any amino acid
XPDPREGAAAGPAVPTHLLPRGEERCHLGTVQAGGAGPDLPAALGGTGLPGEAAGGLCLGPGHMQPCVCPLDATCSEP

SEQ ID NO: 37284 - protein, 233 aa, Homo sapiens
  ENSP00000450958
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQFGLWASWLAWLAITTLAFLKVYHNYRQEDLLDSLIHEKELLLARPSPRTSFQEEKSAVI

SEQ ID NO: 37285 - protein, 197 aa, Homo sapiens
  ENSP00000340477
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVGGSGQEGRLAMLGGGHLLLDIC

SEQ ID NO: 37286 - protein, 211 aa, Homo sapiens
  ENSP00000483627
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQVQFRTPGWPLKALAGRGWPEDASPGQEPSKGAGHGWA

SEQ ID NO: 37287 - protein, 182 aa, Homo sapiens
  ENSP00000479740
MCTPVRVSIVCVMGAVGAVWTAPLPLPWAPTPSIHLREEGAAFPFCRVCVLRPRRSKWRSWDVNLGPRRRGLLGCGPCPSGKPRVHLQRTRSGAGAEAGGLPTRGSMRGCPFLGSSAAKCSLLLRPPSRGEASPWLPEFMTHPVHHQQLACVSGWLGTSLLEATCLGPHGGSWWGHHPGSRE

SEQ ID NO: 37288 - protein, 189 aa, Homo sapiens
  ENSP00000481424
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQGSLIDSHGVETPPGQ

SEQ ID NO: 37289 - protein, 78 aa, Homo sapiens; identical to SEQ ID NO: 37283
  ENSP00000486955
  MOD_RES (1)..(1): Any amino acid

SEQ ID NO: 37290 - protein, 233 aa, Homo sapiens; identical to SEQ ID NO: 37284
  ENSP00000485891

SEQ ID NO: 37291 - protein, 197 aa, Homo sapiens; identical to SEQ ID NO: 37285
  ENSP00000487568

SEQ ID NO: 37292 - protein, 211 aa, Homo sapiens; identical to SEQ ID NO: 37286
  ENSP00000484829

SEQ ID NO: 37293 - protein, 182 aa, Homo sapiens; identical to SEQ ID NO: 37287
  ENSP00000477614

SEQ ID NO: 37294 - protein, 438 aa, Homo sapiens
  ENSP00000296582
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWQAVVIALLVKVGVISEKHTWEWQTVEAVATGLQDFIICIEMFLAAIAHHYTFSYKPYVQEAEEGSCFDSFLAMWDVSDIRDDISEQVRHVGRTVRGHPRKKLFPEDQDQNEHTSLLSSSSQDAISIASSMPPSPMGHYQGFGHTVTPQTTPTTAKISDEILSDTIGEKKEPSDKSVDS

SEQ ID NO: 37295 - protein, 261 aa, Homo sapiens
  ENSP00000425940
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWP

SEQ ID NO: 37296 - protein, 72 aa, Homo sapiens
  ENSP00000421159
LGIYDEGNFSFSNAWTYLVIINNMSQLFAMYCLLLFYKVLKEELSPIQPVGKFLCVKLVVFVSFCIRGNGKL

SEQ ID NO: 37297 - protein, 360 aa, Homo sapiens
  ENSP00000343507
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 37298 - protein, 227 aa, Homo sapiens
  ENSP00000388087
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLL

SEQ ID NO: 37299 - protein, 360 aa, Homo sapiens; identical to SEQ ID NO: 37297
  ENSP00000362990

SEQ ID NO: 37300 - protein, 156 aa, Homo sapiens
  ENSP00000415186
MGPRFWGGPSPGSCAFPFLRPSPSSRTPRDWSASRCWTWSGAATAPTPFSPAQQPPSSHDGLSLDPSQLEPLAPRNPGPSGLCTASFTQKLRSPPAQLLPPEPDDAFWGAPCEQPLERRYQALPALVCIMCCLFGVVYCFFGYRCFKAVLFLTGLL

SEQ ID NO: 37301 - protein, 1383 aa, Homo sapiens
  ENSP00000366243
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 37302 - protein, 1320 aa, Homo sapiens
  ENSP00000366266
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 37303 - protein, 580 aa, Homo sapiens
  ENSP00000437750
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSR

SEQ ID NO: 37304 - protein, 376 aa, Homo sapiens
  ENSP00000379569
MTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 37305 - protein, 178 aa, Homo sapiens
  ENSP00000366254
LIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGDGVSLCCPGWSAVHRHSCGTLQP

SEQ ID NO: 37306 - protein, 176 aa, Homo sapiens
  ENSP00000366242
GFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKYVSVTVISNS

SEQ ID NO: 37307 - protein, 18 aa, Homo sapiens
  ENSP00000444571
MYATDSRGHSPAFLQPQN

SEQ ID NO: 37308 - protein, 491 aa, Homo sapiens
  ENSP00000296978
MIATGGVITGLAALKRQDSARSQQHVNLSPSPATQEKKPIRRRPRADVVVVRGKIRLYSPSGFFLILGVLISIIGIAMAVLGYWPQKEHFIDAETTLSTNETQVIRNEGGVVVRFFEQHLHSDKMKMLGPFTMGIGIFIFICANAILHENRDKETKIIHMRDIYSTVIDIHTLRIKEQRQMNGMYTGLMGETEVKQNGSSCASRLAANTIASFSGFRSSFRMDSSVEEDELMLNEGKSSGHLMPPLLSDSSVSVFGLYPPPSKTTDDKTSGSKKCETKSIVSSSISAFTLPVIKLNNCVIDEPSIDNITEDADNLKSRSRNLSMDSLVVPLPNTSESFQPVSTVLPRNNSIGESLSSQYKSSMALGPGAGQLLSPGAARRQFGSNTSLHLLSSHSKSLDLDRGPSTLTVQAEQRKHPSWPRLDRNNSKGYMKLENKEDPMDRLLVPQVAIKKDFTNKEKLLMISRSHNNLSFEHDEFLSNNLKRGTSETRF

SEQ ID NO: 37309 - protein, 491 aa, Homo sapiens; identical to SEQ ID NO: 37308
  ENSP00000376224

SEQ ID NO: 37310 - protein, 491 aa, Homo sapiens; identical to SEQ ID NO: 37308
  ENSP00000480294

SEQ ID NO: 37311 - protein, 491 aa, Homo sapiens; identical to SEQ ID NO: 37308
  ENSP00000438928

SEQ ID NO: 37312 - protein, 170 aa, Homo sapiens
  ENSP00000366528
MQNRTGLILCALALLMGFLMVCLGAFFISWGSIFDCQGSLIAAYLLLPLGFVILLSGIFWSNYRQVTESKGVLRHMLRQHLAHGALPVATVDRPDFYPPAYEESLEVEKQSCPAEREASGIPPPLYTETGLEFQDGNDSHPEAPPSYRESIAGLVVTAISEDAQRRGQEC

SEQ ID NO: 37313 - protein, 123 aa, Homo sapiens
  ENSP00000361355
MATAAGATYFQRGSLFWFTVITLSFGYYTWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 37314 - protein, 84 aa, Homo sapiens
  ENSP00000361349
MATAAGATYFQRGSLFWFTVITLSFGYYTWVVFWPQSIPYQNLGPLGPFTQYLVDHHHTLLCNGYWLAWLIHVGESLYAIVLCK

SEQ ID NO: 37315 - protein, 103 aa, Homo sapiens
  ENSP00000361348
MATAAGATYFQRGSLFWFTVITLSFGYYTWVVFWPQSIPYQNLGPLGPFTQYLVDHHHTLLCNGYWLAWLIHVGESLYAIVLCKQNELRIRIKMRKLILRDSE

SEQ ID NO: 37316 - protein, 144 aa, Homo sapiens
  ENSP00000361347
  MOD_RES (1)..(1): Any amino acid
XTAGELPANSVSGFFKRMVKSEASNAATAYFRPARPLPSLVTVLGLGYFAWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 37317 - protein, 101 aa, Homo sapiens
  ENSP00000393450
  MOD_RES (1)..(1): Any amino acid
XEFLRSVWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 37318 - protein, 101 aa, Homo sapiens
  ENSP00000482766
MATAAGATYFQRGSLFWFTVITLSFGYYTPQQRSETLSKKKERKKIEAKNGDPNDCSEFLRGLSSGLRVSLIRTLGPWAPSLSTWWTTITPSCAMGIGLPG

SEQ ID NO: 37319 - protein, 103 aa, Homo sapiens; identical to SEQ ID NO: 37315
  ENSP00000361351

SEQ ID NO: 37320 - protein, 349 aa, Homo sapiens
  ENSP00000310110
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVISSSTKNSPSTRVMRNLTQAAREVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 37321 - protein, 325 aa, Homo sapiens
  ENSP00000360420
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 37322 - protein, 185 aa, Homo sapiens
  ENSP00000360403
MVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 37323 - protein, 149 aa, Homo sapiens
  ENSP00000428013
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEENPTLPALN

SEQ ID NO: 37324 - protein, 241 aa, Homo sapiens
  ENSP00000405781
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEENPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 37325 - protein, 15 aa, Homo sapiens
  ENSP00000488630
MQPPVPGPLGLLDPA

SEQ ID NO: 37326 - protein, 15 aa, Homo sapiens
  ENSP00000488348
MQPPVPGPLGLLDPA

SEQ ID NO: 37327 - protein, 166 aa, Homo sapiens
  ENSP00000479391
MQPPVPGPLGLLDPAEGLSRRKKTSLWFVGSLLLVSVLIVTVGLAATTRTENVTVGGYYPGIILGFGSFLGIIGINLVENRRQMLVAAIVFISFGVVAAFCCAIVDGVFAAQHIEPRPLTTGRCQFYSSGVGYLYDVYQTEVSRSTEIHVGFAQLTPPTPRGFPCT

SEQ ID NO: 37328 - protein, 326 aa, Homo sapiens
  ENSP00000364502
MQPPVPGPLGLLDPAEGLSRRKKTSLWFVGSLLLVSVLIVTVGLAATTRTENVTVGGYYPGIILGFGSFLGIIGINLVENRRQMLVAAIVFISFGVVAAFCCAIVDGVFAAQHIEPRPLTTGRCQFYSSGVGYLYDVYQTEVTCHSLDGKCQLKVRSNTCYCCDLYACGSAEPSPAYYEFIGVSGCQDVLHLYRLLWASAVLNVLGLFLGIITAAVLGAFKDMVPLSQLAYGPAVPPQTLYNPAQQILAYAGFRLTPEPVPTCSSYPLPLQPCSRFPVAPSSALASSEDLQPPSPSSSGSGLPGQAPPCYAPTYFPPGEKPPPYAP

SEQ ID NO: 37329 - protein, 531 aa, Homo sapiens
  ENSP00000373594
MAVAPSFNMTNPQPAIEGGISEVEIISQQVDEETKSIAPVQLVNFAYRDLPLAAVDLSTAGSQLLSNLDEDYQREGSNWLKPCCGKRAAVWQVFLLSASLNSFLVACVILVVILLTLELLIDIKLLQFSSAFQFAGVIHWISLVILSVFFSETVLRIVVLGIWDYIENKIEVFDGAVIILSLAPMVASTVANGPRSPWDAISLIIMLRIWRVKRVIDAYVLPVKLEMEMVIQQYEKAKVIQDEQLERLTQICQEQGFEIRQLRAHLAQQDLDLAAEREAALQAPHVLSQPRSRFKVLEAGTWDEETAAESVVEELQPSQEATMKDDMNSYISQYYNGPSSDSGVPEPAVCMVTTAAIDIHQPNISSDLFSLDMPLKLGGNGTSATSESASRSSVTRAQSDSSQTLGSSMDCSTAREEPSSEPGPSPPPLPSQQQVEEATVQDLLSSLSEDPCPSQKALDPAPLARPSPAGSAQTSPELEHRVSLFNQKNQEGFTVFQIRPVIHFQPTVPMLEDKFRSLESKEQKLHRVPEA

SEQ ID NO: 37330 - protein, 101 aa, Homo sapiens
  ENSP00000435049
MAVAPSFNMTNPQPAIEGGISEVEIISQQVDEETKSIAPVQLVNFAYRDLPLAAVDLSTAGSQLLSNLDEDYQREGSNWLKPCCGKRAAVWQFPAHSSLLA

SEQ ID NO: 37331 - protein, 121 aa, Homo sapiens
  ENSP00000453957
MAVAPSFNMTNPQPAIEGGISEVEIISQQVDEETKSIAPVQLVNFAYRDLPLAAVDLSTAGSQLLSNLDEDYQREGFQRIPVCWRDSLDQPGHSVRVLLRDCSTDCGAWDLGLHRKQNRGV

SEQ ID NO: 37332 - protein, 475 aa, Homo sapiens
  ENSP00000376227
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIAPPPTLGITTQHEIWRGQMSKPSQSPSRSPSGHWRAAAQRQVLGTEMCRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 37333 - protein, 197 aa, Homo sapiens
  ENSP00000409963
LRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEQKYWEALNSEQWDPEDVNLEGSKENVELLGSQVHQDSVRTAHLSDDD

SEQ ID NO: 37334 - protein, 396 aa, Homo sapiens
  ENSP00000371402
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAAVPPGCQVTGRRAPEMRPCRTPRRTLPFRSSGPGCLPAAPLRSPPSTPTWSGTLKM

SEQ ID NO: 37335 - protein, 428 aa, Homo sapiens
  ENSP00000333355
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 37336 - protein, 438 aa, Homo sapiens
  ENSP00000418674
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRICRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEKYWEALNSEQWDPEDVNLEGSKENVELLGSQVHQDSVRTAHLSDDD

SEQ ID NO: 37337 - protein, 261 aa, Homo sapiens
  ENSP00000414333
NFMFILFPVCGSKFKSNSDREARERKRRRQLRASVFALALPLSLGPCWALWVAVPKASATIRGPQRRLLASLLQENTEILGYLLGSVAAFGSWASRIPPLSRISKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 37338 - protein, 119 aa, Homo sapiens
  ENSP00000403053
MKSKMRQALGFAKEARESPDTQALLTCAEKEEENQENLDWVPLTTLSHCKSLRTMTAISRYMELTIEPVQQAAVPPGCQVTGRRAPEMRPCRTPRRTLPFRSSGPGCLPAAPLSGTLKM

SEQ ID NO: 37339 - protein, 150 aa, Homo sapiens
  ENSP00000414077
MFILFPVCGSKFKSNSDREARERKRRRQLRASVFALALPLSLGPCWALWVAVPKASATIRGPQRRLLASLLQENTEILGYLLGSVAAFGSWASRIPPLSRIMESRCVAQAGVQWRDLGSLQPSPPNFKQFSCLSLPSSWDYSCQWSCRSC

SEQ ID NO: 37340 - protein, 113 aa, Homo sapiens
  ENSP00000328300
MFILFPVCGSKFKSNSDREARERKRRRQLRASVFALALPLSLGPCWALWVAVPKASATIRGPQRRLLASLLQENTEILGYLLGSVAAFGSWASRIPPLSRIVRPGVGMGLWVT

SEQ ID NO: 37341 - protein, 121 aa, Homo sapiens
  ENSP00000390186
MGEAPSPAPALWDWDYLDRCFARHRVCISFGLWICASSCWIAAHALLLYLRCAQKPRQDQSALCAACCLLTSLCDTVGALLARQLTIQSVDPNSSLIQIGKPERGRGGGSSGPVCLPWPCR

SEQ ID NO: 37342 - protein, 253 aa, Homo sapiens
  ENSP00000365182
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEEDEEAASRYYVPSYEEVMNTNYSEARGEEQNPRLSISLPSYESLTGLDETTPTSTRADVEASPGNPPDRQNSKLAKRLKPLKVRRIKSEKLHLKDFRINLPDKNVPPPSIEPLTPPPQYDEVQEKAPDTRPPD

SEQ ID NO: 37343 - protein, 121 aa, Homo sapiens
  ENSP00000412298
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEE

SEQ ID NO: 37344 - protein, 253 aa, Homo sapiens; identical to SEQ ID NO: 37342
  ENSP00000383600

SEQ ID NO: 37345 - protein, 135 aa, Homo sapiens
  ENSP00000409665
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDRRKKRRMRRLPQGTMFPATRK

SEQ ID NO: 37346 - protein, 253 aa, Homo sapiens; identical to SEQ ID NO: 37342
  ENSP00000365176

SEQ ID NO: 37347 - protein, 253 aa, Homo sapiens; identical to SEQ ID NO: 37342
  ENSP00000394899

SEQ ID NO: 37348 - protein, 807 aa, Homo sapiens
  ENSP00000355800
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 37349 - protein, 118 aa, Homo sapiens
  ENSP00000409002
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLT

SEQ ID NO: 37350 - protein, 82 aa, Homo sapiens
  ENSP00000445237
MKDRLLERITEEERHVQDQPLGMAFVTFQEKSMATYILKDFNACKCQSLQCKGEPQPSSHSRELYTSKWTVTFAADPEDICW

SEQ ID NO: 37351 - protein, 163 aa, Homo sapiens
  ENSP00000455099
MSEQGRETEEEEGGGGASDTAPMLPRGPPDHQASALTCPGWSGPPLLPGRLLAGLLLHLLLPAAAFLLVLLPAAAVVYLGFLCHSRVHPAPGPRCRALFSDRGSAALIVFGLLSLPPLLVLASAVRARLARRLRPLLPPPAGTPGPRRPPGRPDEDEQLCAWV

SEQ ID NO: 37352 - protein, 226 aa, Homo sapiens
  ENSP00000378138
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 37353 - protein, 226 aa, Homo sapiens; identical to SEQ ID NO: 37352
  ENSP00000463245

SEQ ID NO: 37354 - protein, 137 aa, Homo sapiens
  ENSP00000398446
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISP

SEQ ID NO: 37355 - protein, 201 aa, Homo sapiens
  ENSP00000261713
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRTTALLLSVSHLVLVTRNACHLTGGLDWIDQSLSAAEEHLEVLREAALASEPDKGLPGPEGFLQ

SEQ ID NO: 37356 - protein, 138 aa, Homo sapiens
  ENSP00000464537
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPR

SEQ ID NO: 37357 - protein, 222 aa, Homo sapiens
  ENSP00000406394
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQE

SEQ ID NO: 37358 - protein, 93 aa, Homo sapiens
  ENSP00000463539
METVVIVAIGVLATIFLASFAALVLVCRQRYCRPRDLLQRYDSKPIVDLIGAMETQSEPSELELDDVVITNPHIEAILENEDWIEDASGLMSH

SEQ ID NO: 37359 - protein, 359 aa, Homo sapiens
  ENSP00000259365
MSYRRELEKYRDLDEDEILGALTEEELRTLENELDELDPDNALLPAGLRQKDQTTKAPTGPFKREELLDHLEKQAKEFKDREDLVPYTGEKRGKVWVPKQKPLDPVLESVTLEPELEEALANASDAELCDIAAILGMHTLMSNQQYYQALSSSSIMNKEGLNSVIKPTQYKPVPDEEPNSTDVEETLERIKNNDPKLEEVNLNNIRNIPIPTLKAYAEALKENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 37360 - protein, 232 aa, Homo sapiens
  ENSP00000364318
MSQVLSILGMHTLMSNQQYYQALSSSSIMNKEGLNSVIKPTQYKPVPDEEPNSTDVEETLERIKNNDPKLEEVNLNNIRNIPIPTLKAYAEALKENSYVKKFSIVGTRSNDPVAYALAEMLKENKVLKTLNVESNFISGAGILRLVEALPYNTSLVEMKIDNQSQPLGNKVEMEIVSMLEKNATLLKFGYHFTQQGPRLRASNAMMNNNDLVRKRRLADLTGPIIPKCRSGV

SEQ ID NO: 37361 - protein, 359 aa, Homo sapiens; identical to SEQ ID NO: 37359
  ENSP00000378637

SEQ ID NO: 37362 - protein, 147 aa, Homo sapiens
  ENSP00000437937
MHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQDSLL

SEQ ID NO: 37363 - protein, 198 aa, Homo sapiens
  ENSP00000437761
MHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 37364 - protein, 457 aa, Homo sapiens
  ENSP00000299882
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 37365 - protein, 448 aa, Homo sapiens
  ENSP00000441104
MTGWGQWRAIILHSPDPPWGQPHMIDVSQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 37366 - protein, 413 aa, Homo sapiens
  ENSP00000445528
MRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 37367 - protein, 388 aa, Homo sapiens
  ENSP00000440783
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 37368 - protein, 344 aa, Homo sapiens
  ENSP00000445930
MRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 37369 - protein, 17 aa, Homo sapiens
  ENSP00000443681
MHSFRLARLSSWRVHAG

SEQ ID NO: 37370 - protein, 10 aa, Homo sapiens
  ENSP00000445502
MHSFRLARLS

SEQ ID NO: 37371 - protein, 44 aa, Homo sapiens
  ENSP00000440976
MSLMLDDQPPMEAQYAEEGPGPGIFRAEPGDQQHPSRPDWAIGE

SEQ ID NO: 37372 - protein, 774 aa, Homo sapiens
  ENSP00000256062
MNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 37373 - protein, 944 aa, Homo sapiens
  ENSP00000448112
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 37374 - protein, 906 aa, Homo sapiens
  ENSP00000449043
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 37375 - protein, 882 aa, Homo sapiens
  ENSP00000442046
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 37376 - protein, 130 aa, Homo sapiens
  ENSP00000449054
FRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALNNNKAWDYLCWRFRKTLTDLP

SEQ ID NO: 37377 - protein, 741 aa, Homo sapiens
  ENSP00000365408
MAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 37378 - protein, 760 aa, Homo sapiens
  ENSP00000343871
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 37379 - protein, 630 aa, Homo sapiens
  ENSP00000365409
MAVLDTDLDHILPSSVLPPFWAKLVVGSVAIVCFARSYDGDFVFDDSEAIVNNKVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 37380 - protein, 114 aa, Homo sapiens
  ENSP00000393600
MAVLDTDLDHILPSSVLPPFWAKLVVGSVAIVCFARSYDGDFVFDDSEAIVNNKHTLLWRLHLIKYLEPRWCSFPVQREEKILCRSPSQLTGYFCKSVEEGPPSRNAPGGPVAS

SEQ ID NO: 37381 - protein, 54 aa, Homo sapiens
  ENSP00000398400
MAVLDTDLDHILPSSVLPPFWAKLVVGSVAIVCFARSYDGDFVFDDSEAIVNNK

SEQ ID NO: 37382 - protein, 73 aa, Homo sapiens
  ENSP00000419613
MIPNQHNAGAGSHQPAVFRMAVLDTDLDHILPSSVLPPFWAKLVVGSVAIVCFARSYDGDFVFDDSEAIVNNK

SEQ ID NO: 37383 - protein, 1928 aa, Homo sapiens
  ENSP00000411406
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 37384 - protein, 2201 aa, Homo sapiens
  ENSP00000265131
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 37385 - protein, 1838 aa, Homo sapiens
  ENSP00000438152
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAKEPEIGNLNVSDITPESFNLSWMATDGIFETFTIEIIDSNRLLETVEYNISGAERTAHISGLPPSTDFIVYLSGLAPSIRTKTISATATTEPKPQLGTLIFSNITPKSFNMSWTTQAGLFAKIVINVSDAHSLHESQQFTVSGDAKQAHITGLVENTGYDVSVAGTTLAGDPTRPLTAFVITEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 37386 - protein, 92 aa, Homo sapiens
  ENSP00000443469
MGAMTQLLAGVFLAFLALATEGGVLKKVIRHKRQSGVNATLPEENQPVVFNHVYNIKLPVGSQCSVDLESASGEKDLAPPSEPSESFQEHTV

SEQ ID NO: 37387 - protein, 23 aa, Homo sapiens
  ENSP00000489385
ASTEAEPEVDNLLVSDATPDGFR

SEQ ID NO: 37388 - protein, 615 aa, Homo sapiens
  ENSP00000445380
  MOD_RES (1)..(1): Any amino acid
XPELENLTVTEVGWDGLRLNWTAADQAYEHFIIQVQEANKVEAARNLTVPGSLRAVDIPGLKAATPYTVSIYGVIQGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRRE

SEQ ID NO: 37389 - protein, 1838 aa, Homo sapiens; identical to SEQ ID NO: 37385
  ENSP00000442242

SEQ ID NO: 37390 - protein, 1564 aa, Homo sapiens
  ENSP00000443478
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 37391 - protein, 2019 aa, Homo sapiens
  ENSP00000339553
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 37392 - protein, 277 aa, Homo sapiens
  ENSP00000243347
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 37393 - protein, 184 aa, Homo sapiens
  ENSP00000291232
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 37394 - protein, 417 aa, Homo sapiens
  ENSP00000248484
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 37395 - protein, 423 aa, Homo sapiens
  ENSP00000371693
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 37396 - protein, 417 aa, Homo sapiens; identical to SEQ ID NO: 37394
  ENSP00000371698

SEQ ID NO: 37397 - protein, 285 aa, Homo sapiens
  ENSP00000385408
MECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQEA

SEQ ID NO: 37398 - protein, 254 aa, Homo sapiens
  ENSP00000245817
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 37399 - protein, 607 aa, Homo sapiens
  ENSP00000398614
LSAQDISQPLQNSFIHTGHGDSDPRHCWGFPDRIDELYLGNPMDPPDLLSVELSTSRPPQHLGGVKREPPPRPPQPAFFTQKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMLQAMVHGVTTEECQAALQCHGWSVQRAAQYLKVEQLFGLGLRPRGECHKVLEMFDWNLEQAGCHLLGSWGPAHHKR

SEQ ID NO: 37400 - protein, 1086 aa, Homo sapiens
  ENSP00000371341
MLEARPPRTQGSDAAGAAAGRGLRALLLSLTAAAGIWGSMGERSAYQRLAGGEEGPQRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKREPPPRPPQPAFFTQKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMVEQLFGLGLRPRGECHKVLEMFDWNLEQAGCHLLGSWGPAHHKR

SEQ ID NO: 37401 - protein, 1038 aa, Homo sapiens
  ENSP00000329425
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMAMVHGVTTEECQAALQCHGWSVQRAAQYLKVEQLFGLGLRPRGECHKVLEMFDWNLEQAGCHLLGSWGPAHHKR

SEQ ID NO: 37402 - protein, 1040 aa, Homo sapiens
  ENSP00000392546
MPAARRFPGLELSFPLLARLRRRLYTRLGGGRMQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPPPAYDDVAQDEDDFEICSINSTLVGAGVPAGPSQGQTNYAFVPEQARPPPPLEDNLFLPPQGGGKPPSSAQTAEIFQALQQECMRQLQAPAGSPAPSPSPGGDDKPQVPPRVPIPPRPTRPHVQLSPAPPGEEETSQWPGPASPPRVPPREPLSPQGSRTPSPLVPPGSSPLPPRLSSSPGKTMPTTQSFASDPKYATPQVIQAPGPRAGPCILPIVRDGKKVSSTHYYLLPERPSYLERYQRFLREAQSPEEPTPLPVPLLLPPPSTPAPAAPTATVRPMPQAALDPKANFSTNNSNPGARPPPPRATARLPQRGCPGDGPEAGRPADKIQMVEQLFGLGLRPRGECHKVLEMFDWNLEQAGCHLLGSWGPAHHKR

SEQ ID NO: 37403 - protein, 528 aa, Homo sapiens
  ENSP00000395588
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMVQCWAHKPEDRPTFVALRDFLLEAQPTDMRALQDFEEPDKLHIQMNDVITVIEGRAENYWWRGQNTRTLCVGPFPRNVVTSVAGLSAQDISQPLQNSFIHTGHGDSDPRHCWGFPDRIDECPFSAFSPGHPPAETCGQVLWTGRREACASDPRLHPVSSRTKGL

SEQ ID NO: 37404 - protein, 242 aa, Homo sapiens
  ENSP00000390435
  MOD_RES (1)..(1): Any amino acid
XLWGLLPPGPPALAWNHSTCPPCLELLRRAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARVPGTKASRGSGAEVTLIDFGEEPVVPALRPCAPSLAQLAMDACSLLDETPPQSPTRALPRPLHPTPVVDWDARPLPPP

SEQ ID NO: 37405 - protein, 200 aa, Homo sapiens
  ENSP00000415126
VGPSRWFPVAAAGGALGAPSPWATSPGLEPQHLPSVPGAAQESLNISMFVWLPPSPCLQADGSVAENYWWRGQNTRTLCVGPFPRNVVTSVAGLSAQDISQPLQNSFIHTGHGDSDPRHCWGFPDRIDELYLGNPMDPPDLLSVELSTSRPPQHLGGVKKPTYDPVSEDQDPLSSDFKRLGLRKPGLPRGLWLAKPSARV

SEQ ID NO: 37406 - protein, 290 aa, Homo sapiens
  ENSP00000392253
  MOD_RES (1)..(1): Any amino acid
XPEEGTGWLLELLSEVQLQQYFLRLRDDLNVTRLSHFEYVKNEDLEKIGMGRPGQRRLWEAVKRRKALCKRKSWMSKVSVAVKCLKPDVLSQPEAMDDFIREVNAMHSLDHRNLIRLYGVVLTPPMKMVTELAPLGSLLDRLRKHQGHFLLGTLSRYAVQVAEGMGYLESKRFIHRDLAARNLLLATRDLVKIGDFGLMRALPQNDDHYVMQEHRKVPFAWCAPESLKTRTFSHASDTWMFGVTLWEMFTYGQEPWIGLNGSQILHKIDKEGERLPRPEDCPQDIYNVMV

SEQ ID NO: 37407 - protein, 143 aa, Homo sapiens
  ENSP00000409462
VFSGKRLEAEFPPHHSQSTFRKTSPAPGGPAGEGPLQSLTCLIGEKDLRLLEKLGDGSFGVVRRGEWDAPSGKTVSVAVKCLKPDVLSQPEAMDDFIREVNAMHSLDHRNLIRLYGVVLTPPMKMASVSQIASRERPEKLQDS

SEQ ID NO: 37408 - protein, 86 aa, Homo sapiens
  ENSP00000393707
MQPEEGTGWLLELLSEVQLQQYFLRLRDDLNVTRLSHFEYVKNEDLEKIGMGRPGQRRLWEAVKRRKALCKRKSWMSKDEGQPTPW

SEQ ID NO: 37409 - protein, 97 aa, Homo sapiens
  ENSP00000395154
MQPEEGTGWLLELLSEVQLQQYFLRLRDDLNVTRLSHFEYVKNEDLEKIGMGRPGQRRLWEAVKRRKALCKRKSWMSKVFSGKRLEAEFPPHHSQST

SEQ ID NO: 37410 - protein, 143 aa, Homo sapiens
  ENSP00000390088
MRSGALGPRGRGRASALGLPVPAMASRQCWARHPRVGLCWAAFEQESGPSCHRSEVKERLGGGRMQPEEGTGWLLELLSEVQLQQYFLRLRDDLNVTRLSHFEYVKNEDLEKIGMGRPGQRRLWEAVKRRKALCKRKSWMSKV

SEQ ID NO: 37411 - protein, 187 aa, Homo sapiens
  ENSP00000354488
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEKERPVEVGDWRKNVEAMSGMEGRKKMFDAAKSPTSQ

SEQ ID NO: 37412 - protein, 187 aa, Homo sapiens; identical to SEQ ID NO: 37411
  ENSP00000337022

SEQ ID NO: 37413 - protein, 105 aa, Homo sapiens
  ENSP00000451307
MPEVERKPKITASRKLLLKSLMLAKAKECWEQEHEEREAEKVRYLAERIPTLQTRGLSLSALQDLCRELHAKVEVVDEERYDIEAMSGMEGRKKMFDAAKSPTSQ

SEQ ID NO: 37414 - protein, 187 aa, Homo sapiens; identical to SEQ ID NO: 37411
  ENSP00000356281

SEQ ID NO: 37415 - protein, 131 aa, Homo sapiens
  ENSP00000451660
MLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMDLRANLKSVKKEDTEK

SEQ ID NO: 37416 - protein, 137 aa, Homo sapiens
  ENSP00000451776
MPEVERKPKITASRKLLLKSLMLAKAKECWEQEHEEREAEKVRYLAERIPTLQTRGLSLSALQDLCRELHAKVEVVDEERYDIEAKCLHNTREIKDLKLKVMDLRGKFKRPPLRRVRVSADAMLRALLGSKHKVSMD

SEQ ID NO: 37417 - protein, 187 aa, Homo sapiens [sequence omitted]

SEQ ID NO: 37418 - protein, 1358 aa, Homo sapiens
  ENSP00000356646
MGADGETVVLKNMLIGINLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 37419 - protein, 180 aa, Homo sapiens
  ENSP00000403413
  MOD_RES (1)..(1): Any amino acid
XINFPKKACPCASSAQVLQELLSRIEMLEREVSVLRDQCNANCCQESAATVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNE

SEQ ID NO: 37420 - protein, 1358 aa, Homo sapiens; identical to SEQ ID NO: 37418
  ENSP00000263525

SEQ ID NO: 37421 - protein, 1735 aa, Homo sapiens
  ENSP00000171887
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEEDEGKVVVRLSEEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 37422 - protein, 846 aa, Homo sapiens
  ENSP00000394171
MEQLVKERKGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 37423 - protein, 1721 aa, Homo sapiens
  ENSP00000408724
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGVTRRRIQPEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 37424 - protein, 1714 aa, Homo sapiens
  ENSP00000406016
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 37425 - protein, 780 aa, Homo sapiens
  ENSP00000405460
MTWICLSCMLWPEDLEAPKTHRFKVKTFKKVKPCGICRQVITQEGCTCKVCSFSCHRKCQAKVAAPCVPPSNHELVPITTENAPKNVVDKGEGASRGGNTRKSLEDNGSTRVTPSVQPHLQPIRNMSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQ

SEQ ID NO: 37426 - protein, 487 aa, Homo sapiens
  ENSP00000400383
MVSPLPPPHCPGAALHVQPYKAAASHGPHGASPGGAGSMPLKLVGKVLLKGSTRVTPSVQPHLQPIRNMSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEEVVGHTQGPLDGSLYAKVKKKDSLHGSTGAVNATRPTLSATPNHVEHTLSVSSDSGNSTASTKTDKTD

SEQ ID NO: 37427 - protein, 416 aa, Homo sapiens
  ENSP00000308321
MVPFQQRKDCVLEGSTRVTPSVQPHLQPIRNMSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLNADPHNVVVLHNKGNRGRIGVVIAAYMHYSNISASADQALDRFAMKRFYEDKIVPIGQPSQRRYVHYFSGLLSGSIKMNNKPLFLHHVIMHGIPNFESKGGCRPFLRIYQAMQPVYTSGIYNIPGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEDGNKQNTNSQSIGSISGGLEDQYTWPDTHWPSQS

SEQ ID NO: 37428 - protein, 149 aa, Homo sapiens
  ENSP00000414704
  MOD_RES (1)..(1): Any amino acid
XGDSQTSVCITIEPGLLLKGDILLKCYHKKFRSPARDVIFRVQFHTCAIHDLGVVFGKEDLDDAFKDDRFPEYGKVEFVFSYGPEKIQGMEHLENGPSVSVDYNTSDPLIRWDSYDNFSGHRDDGMEGAQHPQIGQDTPPGPSDPPGCL

SEQ ID NO: 37429 - protein, 102 aa, Homo sapiens
  ENSP00000395615
MSVSRTMEDSCELDLVYVTERIIAVSFPSTANEENFRSNLREVAQMLKSKHGGNYLLFNLSERRPDITKLHAKVLEFGWPDLHTPALEKICSICKAMDTWLN

SEQ ID NO: 37430 - protein, 61 aa, Homo sapiens
  ENSP00000404477
MSVSRTMEDSCELDLVYVTERIIAVSFPSTANEENFRSNLREVAQMLKSKHGGNYLLFNLS

SEQ ID NO: 37431 - protein, 122 aa, Homo sapiens
  ENSP00000411349
MQVAAPCVPPSNHELVPITTENAPKNVVDKGEGASRGGNTRKSLEDNGSTRVTPSVQPHLQPIRNMSVSRTMEDSCELDLVYVTERIIAVSFPSTANEENFRSNLREVAQMLKSKHGGNYLV

SEQ ID NO: 37432 - protein, 24 aa, Homo sapiens
  ENSP00000393925
MSVSRTMEDSCELDLVYVTERIIA

SEQ ID NO: 37433 - protein, 1721 aa, Homo sapiens; identical to SEQ ID NO: 37423
  ENSP00000484271

SEQ ID NO: 37434 - protein, 1365 aa, Homo sapiens
  ENSP00000480559
MEEVVGHTQGPLDGSLYAKVKKKDSLHGSTGAVNATRPTLSATPNHVEHTLSVSSDSGNSTASTKTDKTDEPVPGASSATAALSPQEKRELDRLLSGFGLEREKQGAMYHTQHLRSRPAGGSAVPSSGRHVVPAQVHVNGGALASERETDILDDELPNQDGHSAGSMGTLSSLDGVTNTSEGGYPEALSPLTNGLDKSYPMEPMVNGGGYPYESASRAGPAHAGHTAPMRPSYSAQEGLAGYQREGPHPAWPQPVTTSHYAHDPSGMFRSQSFSEAEPQLPPAPVRGGSSREAVQRGLNSWQQQQQQQQQPRPPPRQQERAHLESLVASRPSPQPLAETPIPSLPEFPRAASQQEIEQSIETLNMLMLDLEPASAAAPLHKSQSVPGAWPGASPLSSQPLSGSSRQSHPLTQSRSGYIPSGHSLGTPEPAPRASLESVPPGRSYSPYDYQPCLAGPNQDFHSKSPASSSLPAFLPTTHSPPGPQQPPASLPGLTAQPLLSPKEATSDPSRTPEEEPLNLEGLVAHRVAGVQAREKQPAEPPAPLRRRAASDGQYENQSPEATSPRSPGVRSPVQCVSPELALTIALNPGGRPKEPHLHSYKEAFEEMEGTSPSSPPPSGVRSPPGLAKTPLSALGLKPHNPADILLHPTGEPRSYVESVARTAVAGPRAQDSEPKSFSAPATQAYGHEIPLRNGTLGGSFVSPSPLSTSSPILSADSTSVGSFPSGESSDQGPRTPTQPLLESGFRSGSLGQPSPSAQRNYQSSSPLPTVGSSYSSPDYSLQHFSSSPESQARAQFSVAGVHTVPGSPQARHRTVGTNTPPSPGFGWRAINPSMAAPSSPSLSHHQMMGPPGTGFHGSTVSSPQSSAATTPGSPSLCRHPAGVYQVSGLHNKVATTPGSPSLGRHPGAHQGNLASGLHSNAIASPGSPSLGRHLGGSGSVVPGSPCLDRHVAYGGYSTPEDRRPTLSRQSSASGYQAPSTPSFPVSPAYYPGLSSPATSPSPDSAAFRQGSPTPALPEKRRMSVGDRAGSLPNYATINGKVSSPVASGMSSPSGGSTVSFSHTLPDFSKYSMPDNSPETRAKVKFVQDTSKYWYKPEISREQAIALLKDQEPGAFIIRDSHSFRGAYGLAMKVSSPPPTIMQQNKKGDMTHELVRHFLIETGPRGVKLKGCPNEPNFGSLSALVYQHSIIPLALPCKLVIPNRDPTDESKDSSGPANSTADLLKQGAACNVLFVNSVDMESLTGPQAISKATSETLAADPTPAATIVHFKVSAQGITLTDNQRKLFFRRHYPLNTVTFCDLDPQERKWMKTEGGAPAKLFGFVARKQGSTTDNACHLFAELDPNQPASAIVNFVSKVMLNAGQKR

SEQ ID NO: 37435 - protein, 21 aa, Homo sapiens
  ENSP00000387990
  MOD_RES (1)..(1): Any amino acid
XIFCALDPQDRKWIKDGPSSK

SEQ ID NO: 37436 - protein, 1445 aa, Homo sapiens
  ENSP00000312143
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 37437 - protein, 1249 aa, Homo sapiens
  ENSP00000414358
MNWLCRNQDPNPPPQPEELTSSLHAFKNKAFKKSKVCGVCKQIIDGQGISCRACKYSCHKKCEAKVVIPCGVQVRLEQAPGSSTLSSSLCRDKPLRPVILSPTMEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASE

SEQ ID NO: 37438 - protein, 544 aa, Homo sapiens
  ENSP00000396914
MPEELTSSLHAFKNKAFKKSKVCGVCKQIIDGQGISCRACKYSCHKKCEAKVVIPCGVQVRLEQAPGSSTLSSSLCRDKPLRPVILSPTMEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTR

SEQ ID NO: 37439 - protein, 250 aa, Homo sapiens
  ENSP00000389285
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGIYNVGPENPSRICIVIEPAQLLKGDVMVMNYNIANI

SEQ ID NO: 37440 - protein, 138 aa, Homo sapiens
  ENSP00000409415
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRF

SEQ ID NO: 37441 - protein, 108 aa, Homo sapiens
  ENSP00000388142
MEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCR

SEQ ID NO: 37442 - protein, 114 aa, Homo sapiens
  ENSP00000407464
MCSRQRSGFGCITNWWKMGTRHPAHPAQPEELTSSLHAFKNKAFKKSKVCGVCKQIIDGQGISCRACKYSCHKKCEAKVVIPCGVQVRLEQAPGSSTLSSSLCRDKPLRPVILS

SEQ ID NO: 37443 - protein, 250 aa, Homo sapiens; identical to SEQ ID NO: 37439
  ENSP00000388318

SEQ ID NO: 37444 - protein, 345 aa, Homo sapiens
  ENSP00000427695
MQLEIQVALNFIISYLYNKLPRRRVNIFGEELERLLKKKYEGHWYPEKPYKGSGFRCIHIGEKVDPVIEQASKESGLDIDDVRGNLPQDLSVWIDPFEVSYQIGEKGPVKVLYVDDNNENGCELDKEIKNSFNPEAQVFMPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 37445 - protein, 345 aa, Homo sapiens; identical to SEQ ID NO: 37444
  ENSP00000268957

SEQ ID NO: 37446 - protein, 346 aa, Homo sapiens
  ENSP00000458553
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLSK

SEQ ID NO: 37447 - protein, 476 aa, Homo sapiens
  ENSP00000460823
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 37448 - protein, 38 aa, Homo sapiens
  ENSP00000459079
MAFGKSHRDPYATSVGHLIAQTQQLFLGRKGYICWSSD

SEQ ID NO: 37449 - protein, 465 aa, Homo sapiens
  ENSP00000408958
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNPVSLQTIAAAPSNQSLPPLPSNHPAMTKSDLQPPNYYEVMEFDPLAPAVTTEAIYEEIDAHQHKGAQNDGD

SEQ ID NO: 37450 - protein, 399 aa, Homo sapiens
  ENSP00000343901
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 37451 - protein, 225 aa, Homo sapiens
  ENSP00000460721
MHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQVLYDFRDYQSKCLLKLFSKL

SEQ ID NO: 37452 - protein, 326 aa, Homo sapiens
  ENSP00000461876
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPRDLVLPCWPGCGLKLLTYGDLPTSAS

SEQ ID NO: 37453 - protein, 469 aa, Homo sapiens
  ENSP00000461284
MAFGKSHRDPYATSVGHLIEKATFAGVQTEDWGQFMHICDIINTTQDGPKDAVKALKKRISKNYNHKEIQLTLSNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 37454 - protein, 106 aa, Homo sapiens
  ENSP00000459003
MCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPA

SEQ ID NO: 37455 - protein, 399 aa, Homo sapiens; identical to SEQ ID NO: 37450
  ENSP00000443099

SEQ ID NO: 37456 - protein, 63 aa, Homo sapiens
  ENSP00000458219
MAFGKSHRDPYATSVGHLIEKATFAGVQTEDWGQFMHICDIINTTQDGLLTCVCRTVVQVSSL

SEQ ID NO: 37457 - protein, 346 aa, Homo sapiens; identical to SEQ ID NO: 37446
  ENSP00000458918

SEQ ID NO: 37458 - protein, 92 aa, Homo sapiens
  ENSP00000460565
MAFGKSHRDPYATSVGHLIEKATFAGVQTEDWGQFMHICDIINTTQDGPKDAVKALKKRISKNYNHKEIQLTLSSRCLLTCVCRTVVQVSSL

SEQ ID NO: 37459 - protein, 199 aa, Homo sapiens
  ENSP00000461215
  MOD_RES (1)..(1): Any amino acid
XFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQEIGKLHSELDMVKMNVRVMSAILMENTPGSENHED

SEQ ID NO: 37460 - protein, 252 aa, Homo sapiens
  ENSP00000458809
  MOD_RES (1)..(1): Any amino acid
XKSHRDPYATSVGHLIEKATFAGVQTEDWGQFMHICDIINTTQDGPKDAVKALKKRISKNYNHKEIQLTLSTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATN

SEQ ID NO: 37461 - protein, 122 aa, Homo sapiens
  ENSP00000461396
MHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSE

SEQ ID NO: 37462 - protein, 229 aa, Homo sapiens
  ENSP00000460213
MPPGEWNQTEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELL

SEQ ID NO: 37463 - protein, 125 aa, Homo sapiens
  ENSP00000467227
  MOD_RES (1)..(1): Any amino acid
XFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEYIFQLQTYVRRI

SEQ ID NO: 37464 - protein, 765 aa, Homo sapiens
  ENSP00000354522
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 37465 - protein, 506 aa, Homo sapiens
  ENSP00000344724
MDVRLYPSAPAVGARPGAEPAGLAHLDYYHGGKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 37466 - protein, 464 aa, Homo sapiens
  ENSP00000390278
MSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 37467 - protein, 464 aa, Homo sapiens; identical to SEQ ID NO: 37466
  ENSP00000362090

SEQ ID NO: 37468 - protein, 488 aa, Homo sapiens
  ENSP00000350849
MQQTRTEAVAGAFSRCLGFCGMRLGLLLLARHWCIAGVFPQKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 37469 - protein, 196 aa, Homo sapiens
  ENSP00000390876
RRRRKRRTPMSRRSLCRPTHSSSETLRPPSRVRTPVPLSVTCPKSWPPCGTAWERNRSRTSRTSLSSPAARDPAHLAHPTPPAAGTGTAATPVGSVASAPAACSPGTNRSTSPNPASLPSLRLAGRHCSEPEGLTAEKRPWPEAGWPIGESSDTPIARGLSLFLNLPPDSAEAAHCPPPAQRTCRNLPPADLLAPG

SEQ ID NO: 37470 - protein, 571 aa, Homo sapiens
  ENSP00000385705
MKCQPRSGARRIEERLHYLITTYLKFGNNNNYMNMAEANNAFFAASETFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 37471 - protein, 576 aa, Homo sapiens
  ENSP00000219746
MDVRFYPAAAGDPASLDFAQCLGYYGYSKFGNNNNYMNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 37472 - protein, 166 aa, Homo sapiens
  ENSP00000457401
MNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSP

SEQ ID NO: 37473 - protein, 60 aa, Homo sapiens
  ENSP00000463843
MDVRFYPAAAGDPASLDFAQCLGYYGYSKHFACRLESVLFIAVCAQPRKAPIPSTQPPST

SEQ ID NO: 37474 - protein, 220 aa, Homo sapiens
  ENSP00000363943
MFQRLSSLFFSTPSPPEDPDCPRAFVSEEDEVDGWLIIDLPDSYAAPPSPGAAPAPAGRPPPAPSLMDESWFVTPPACFTAEGPGLGPARLQSSPLEDLLIEHPSMSVYVTGSTIVLEPGSPSPLPDAALPDGDLSEGELTPARREPRAARHAAPLPARAALLEKAGQVRRLQRARQRAERHALSAKAVQRQNRARESRPRRSKNQSSFIYQPCQRQFNY

SEQ ID NO: 37475 - protein, 220 aa, Homo sapiens; identical to SEQ ID NO: 37474
  ENSP00000363942

SEQ ID NO: 37476 - protein, 88 aa, Homo sapiens
  ENSP00000395784
MFQRLSSLFFSTPSPPEDPDCPRAFVSEEDEVDGWLIIDLPEGPGLGPARLQSSPLEDLLIEHPSMSVYVTGSTIVLEPGSPSPLPDA

SEQ ID NO: 37477 - protein, 77 aa, Homo sapiens
  ENSP00000404410
MFQRLSSLFFSTPSPPEDPDCPRAFVSEEDEVDGWLIIDLPDSYAAPPSPGAAPAPAGRPPPAPSLMDESWFVTPPA

SEQ ID NO: 37478 - protein, 636 aa, Homo sapiens
  ENSP00000367545
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 37479 - protein, 403 aa, Homo sapiens
  ENSP00000475143
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPTWGP

SEQ ID NO: 37480 - protein, 499 aa, Homo sapiens
  ENSP00000346423
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 37481 - protein, 555 aa, Homo sapiens
  ENSP00000474626
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 37482 - protein, 540 aa, Homo sapiens
  ENSP00000474322
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 37483 - protein, 450 aa, Homo sapiens
  ENSP00000367534
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 37484 - protein, 426 aa, Homo sapiens
  ENSP00000367529
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQFFNRIGVSKLHRVFHLPRVTEHLPPAEPDH

SEQ ID NO: 37485 - protein, 587 aa, Homo sapiens
  ENSP00000367537
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 37486 - protein, 565 aa, Homo sapiens
  ENSP00000367539
MDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 37487 - protein, 555 aa, Homo sapiens; identical to SEQ ID NO: 37481
  ENSP00000350366

SEQ ID NO: 37488 - protein, 540 aa, Homo sapiens; identical to SEQ ID NO: 37482
  ENSP00000340740

SEQ ID NO: 37489 - protein, 748 aa, Homo sapiens
  ENSP00000376350
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 37490 - protein, 120 aa, Homo sapiens
  ENSP00000446767
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAI

SEQ ID NO: 37491 - protein, 145 aa, Homo sapiens
  ENSP00000448561
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCR

SEQ ID NO: 37492 - protein, 204 aa, Homo sapiens
  ENSP00000449564
  MOD_RES (1)..(1): Any amino acid
XLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKVYGVELFLKVAGLGPVEYLSSGWNLFDFSVTVFAFLGLLALALNMEPFYFI

SEQ ID NO: 37493 - protein, 104 aa, Homo sapiens
  ENSP00000448010
  MOD_RES (1)..(1): Any amino acid
XGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMAR

SEQ ID NO: 37494 - protein, 888 aa, Homo sapiens
  ENSP00000438125
MESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 37495 - protein, 99 aa, Homo sapiens
  ENSP00000448704
MAVSLDDDVPLILTLDEGGSAPLAPSNGLGQEELPSKRRCCMLCSSKQKPWIPCRVISDVACKAASCFEGASGPCDISMWECYRVCKQMAAAMPSTTPR

SEQ ID NO: 37496 - protein, 816 aa, Homo sapiens
  ENSP00000335300
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 37497 - protein, 107 aa, Homo sapiens
  ENSP00000449944
MNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMV

SEQ ID NO: 37498 - protein, 888 aa, Homo sapiens; identical to SEQ ID NO: 37494
  ENSP00000448083

SEQ ID NO: 37499 - protein, 126 aa, Homo sapiens
  ENSP00000447806
MERLGTPSGLDSTNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMV

SEQ ID NO: 37500 - protein, 147 aa, Homo sapiens
  ENSP00000449560
MERLGTPSGLDSTKDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPK

SEQ ID NO: 37501 - protein, 215 aa, Homo sapiens
  ENSP00000447569
MERLGTPSGLDSTKMESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPA

SEQ ID NO: 37502 - protein, 85 aa, Homo sapiens
  ENSP00000447073
MAVSLDDDVPLILTLDEGGSAPLAPSNGLGQEELPSKNGGSYAIHDSQAPSLSSGGESSPSSPAHNWEMNYQEAAIYLQEGENND

SEQ ID NO: 37503 - protein, 124 aa, Homo sapiens
  ENSP00000447263
MESCYIAQAGLELLGSSSSPTLTSQSAEITEDASNGGVSEQHPWPSGFERELKPETISSPGYHILRATGEENMAVSLDDDVPLILTLDEGGSAPLAPSNGLGQEELPSKNGGSYAIHDSQAPSL

SEQ ID NO: 37504 - protein, 99 aa, Homo sapiens; identical to SEQ ID NO: 37495
  ENSP00000447181

SEQ ID NO: 37505 - protein, 248 aa, Homo sapiens
  ENSP00000357521
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 37506 - protein, 248 aa, Homo sapiens
  ENSP00000339035
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDKLKCTKEEHLCTQRMLDQTLLDLNEM

SEQ ID NO: 37507 - protein, 232 aa, Homo sapiens
  ENSP00000341653
MAGITTIEAVKRKIQVLQQQADDAEERAERLQREVEGERRAREQAEAEVASLNRRIQLVEEELDRAQERLATALQKLEEAEKAADEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 37508 - protein, 223 aa, Homo sapiens
  ENSP00000339378
MAGITTIEAVKRKIQVLQQQADDAEERAERLQREVEGESRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 37509 - protein, 248 aa, Homo sapiens
  ENSP00000357520
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDELYAQKLKYKAISEELDHALNDMTSI

SEQ ID NO: 37510 - protein, 49 aa, Homo sapiens
  ENSP00000426521
MAGITTIEAVKRKIQVLQQQADDAEERAERLQREVEGERRAREQRYEGY

SEQ ID NO: 37511 - protein, 285 aa, Homo sapiens
  ENSP00000271850
MMEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 37512 - protein, 158 aa, Homo sapiens
  ENSP00000307712
MKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDKLKCTKEEHLCTQRMLDQTLLDLNEM

SEQ ID NO: 37513 - protein, 247 aa, Homo sapiens
  ENSP00000357517
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEERLYSQLERNRLLSNELKLTLHDLCD

SEQ ID NO: 37514 - protein, 247 aa, Homo sapiens
  ENSP00000357518
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEERLYSQLERNRLLSNELKLTLHDLCD

SEQ ID NO: 37515 - protein, 285 aa, Homo sapiens
  ENSP00000357516
MMEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDELYAQKLKYKAISEELDHALNDMTSI

SEQ ID NO: 37516 - protein, 95 aa, Homo sapiens
  ENSP00000422207
MAGITTIEAVKRKIQVLQQQADDAEERAERLQREVEGERRAREQAEAEVASLNRRIQLVEEELDRAQERLATALQKLEEAEKAADESERWMSRLD

SEQ ID NO: 37517 - protein, 75 aa, Homo sapiens
  ENSP00000426306
MMEAIKKKMQMLKLDKENALDRAEQAEAEQKQAEERSKQLEDELAAMQKKLKGTEDELDKYSEALKDAQEKLELA

SEQ ID NO: 37518 - protein, 227 aa, Homo sapiens
  ENSP00000480520
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKAETRAEFAERSVAKLEKTIDDLEDKLKCTKEEHLCTQRMLDQTLLDLNEM

SEQ ID NO: 37519 - protein, 69 aa, Homo sapiens
  ENSP00000466158
MEAIKKKMQMLKLDKENAIDRAEQAEADKKAAEDKCKQVEEELTHLQKKLKGTEDELDKYSEDLKDAQE

SEQ ID NO: 37520 - protein, 284 aa, Homo sapiens
  ENSP00000345230
MEAIKKKMQMLKLDKENAIDRAEQAEADKKAAEDKCKQVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 37521 - protein, 170 aa, Homo sapiens
  ENSP00000468246
MGSWAGRGVTIGPTPSRASANKVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVS

SEQ ID NO: 37522 - protein, 179 aa, Homo sapiens
  ENSP00000467087
MVEEELTHLQKKLKGTEDELDKYSEDLKDAQEKLELTEKKASDAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSE

SEQ ID NO: 37523 - protein, 96 aa, Homo sapiens
  ENSP00000467558
MKVIENRAMKDEEKMEIQEMQLKEAKHIAEEADRKYEEVARKLVILEGELERAEERAEVSELKCGDLEEELKNVTNNLKSLEAASEKYSEKEDKYE

SEQ ID NO: 37524 - protein, 248 aa, Homo sapiens
  ENSP00000300933
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 37525 - protein, 138 aa, Homo sapiens
  ENSP00000467250
MSSMPATKFSFPFHIFLSCHLSARRIEGWNSNEAPPPRPTLAEGDVAALNRRIQLVEEELDRAQERLATALQKLEEAEKAADESERGMKVIENRAMKDEEKMEIQEMQLKEAKHIAEEADRKYEEVARKLVILEGELE

SEQ ID NO: 37526 - protein, 16 aa, Homo sapiens
  ENSP00000466106
MKVIENRAMKDEEKME

SEQ ID NO: 37527 - protein, 102 aa, Homo sapiens
  ENSP00000466654
MKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLL

SEQ ID NO: 37528 - protein, 110 aa, Homo sapiens
  ENSP00000467319
  MOD_RES (1)..(1): Any amino acid
XLERAEERAEVSELKCGDLEEELKNVTNNLKSLEAASEKYSEKEDKYEEEIKLLSDKLKEAETRAEFAERTVAKLEKTIDDLEEKLAQAKEENVGLHQTLDQTLNELNCI

SEQ ID NO: 37529 - protein, 59 aa, Homo sapiens
  ENSP00000468010
KLLSDKLKEAETRAEFAERTVAKLEKTIDDLEDELYAQKLKYKAISEELDHALNDMTSL

SEQ ID NO: 37530 - protein, 219 aa, Homo sapiens
  ENSP00000353785
MADKAKPAKAANRTPPKSPGDPSKDRAAKRLSLESEGAGEGAAASPELSALEEAFRRFAVHGDARATGREMHGKNWSKLCKDCQVIDGRNVTVTDVDIVFSKIKGKSCRTITFEQFQEALEELAKKRFKDKSSEEAVREVHRLIEGKAPIISGVTKAISSPTVSRLTDTTKFTGSHKERFDPSGKGKGKAGRVDLVDESGYVSGYKHAGTYDQKVQGGK

SEQ ID NO: 37531 - protein, 172 aa, Homo sapiens
  ENSP00000431872
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 37532 - protein, 138 aa, Homo sapiens
  ENSP00000368345
MVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 37533 - protein, 77 aa, Homo sapiens
  ENSP00000433091
  MOD_RES (1)..(1): Any amino acid
XIKHILANFKNYQFFIGENMNPDGMVALLDYREDGVTPYMIFFKDGLEMEKCDAKERNPCAFCLSLWRPRLNWGIHL

SEQ ID NO: 37534 - protein, 77 aa, Homo sapiens; identical to SEQ ID NO: 37533
  ENSP00000432457
  MOD_RES (1)..(1): Any amino acid

SEQ ID NO: 37535 - protein, 160 aa, Homo sapiens
  ENSP00000368350
MFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKC

SEQ ID NO: 37536 - protein, 138 aa, Homo sapiens; identical to SEQ ID NO: 37532
  ENSP00000368344

SEQ ID NO: 37537 - protein, 188 aa, Homo sapiens
  ENSP00000339051
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKCVSTRKWVKINNVKKTF

SEQ ID NO: 37538 - protein, 162 aa, Homo sapiens
  ENSP00000433738
MGGSVYPADDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFF

SEQ ID NO: 37539 - protein, 197 aa, Homo sapiens
  ENSP00000477781
MIIYRDLISHDEMFSDIYKIREIADGLCLEVEGKMVSRTEGNIDDSLIGGNASAEGPEGEGTESTVITGVDIVMNHHLQETSFTKEAYKKYIKDYMKSIKGKLEEQRPERVKPFMTGAAEQIKHILANFKNYQFFIGENMNPDGMVALLDYREDGVTPYMIFFKDGLEMEKCDAKERNPCAFCLSLWRPRLNWGIHL

SEQ ID NO: 37540 - protein, 288 aa, Homo sapiens
  ENSP00000416959
MSDSGEQNYGERESRSASRSGSAHGSGKSARHTPARSRSKEDSRRSRSKSRSRSESRSRSRRSSRRHYTRSRSRSRSHRRSRSRSYSRDYRRRHSHSHSPMSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 37541 - protein, 127 aa, Homo sapiens
  ENSP00000259043
  MOD_RES (1)..(1): Any amino acid
XPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRRRSPSPYYSRGGYRSRSRSRSYSPRRY

SEQ ID NO: 37542 - protein, 107 aa, Homo sapiens
  ENSP00000406561
  MOD_RES (1)..(1): Any amino acid
XMELDGRRIRVDFSITKRPHTPTPGIYMGRPTYGSSRRRDYYDRGYDRGYDDRDYYSRSYRGGGGGGGGWRAAQDRDQIYRRSPSPYYSRGGYRSRSRSRSYSPRRY

SEQ ID NO: 37543 - protein, 38 aa, Homo sapiens
  ENSP00000416887
MSDSGEQNYGERVNVEEGKCGSRHLTSFINEYLKLRNK

SEQ ID NO: 37544 - protein, 188 aa, Homo sapiens
  ENSP00000371626
MSTRRRHVGNRANPDPNCCLGVFGLSLYTTERDLREVFSKYGPIADVSIVYDQQSRRSRGFAFVYFENVDDAKEAKERANGMELDGRRIRVDFSITKRPHTPTPGIYMGRPTYGSSRRRDYYDRGYDRGYDDRDYYSRSYRGGGGGGGGWRAAQDRDQIYRRRSPSPYYSRGGYRSRSRSRSYSPRRY

SEQ ID NO: 37545 - protein, 38 aa, Homo sapiens; identical to SEQ ID NO: 37543
  ENSP00000343857

SEQ ID NO: 37546 - protein, 517 aa, Homo sapiens
  ENSP00000476820
MHAALAGPLLAALLATARARPQPPDGGQCRPPGSQRDLNSFLWTIRRDPPAYLFGTIHVPYTRVWDFIPDNSKAAFQASTRVYFELDLTDPYTISALASCQLLPHGENLQDVLPHELYWRLKRHLDYVKLMMPSWMTPAQRGKGLYADYLFNAIAGNWERKRPVWVMLMVNSLTERDVRFRGVPVLDLYLAQQAEKMKKTTGAVEQVEEQCHPLNNGLNFSQVLFALNQTLLQQESVRAGSLQASYTTEDLIKHYNCGDLSAVIFNHDTSQLPNFINTTLPPHEQVTAQEIDSYFRQELIYKRNERMGKRVMALLRENEDKICFFAFGAGHFLGNNTVIDILRQAGLEVDHTPAGQAIHSPAPQSPAPSPEGTSTSPAPVTPAAAVPEAPSVTPTAPPEDEDPALSPHLLLPDSLSQLEEFGRQRKWHKRQSTHQRPRQFNDLWVRIEDSTTASPPPLPLQPTHSSGTAKPPFQLSDQLQQQDPPGPASSSAPTLGLLPAIATTIAVCFLLHSLGPS

SEQ ID NO: 37547 - protein, 416 aa, Homo sapiens
  ENSP00000362994
MASSSGSSPRPAPDENEFPFGCPPTVCQDPKEPRALCCAGCLSENPRNGEDQICPKCRGEDLQSISPGSRLRTQEKAHPEVAEAGIGCPFAGVGCSFKGSPQSVQEHEVTSQTSHLNLLLGFMKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 37548 - protein, 294 aa, Homo sapiens
  ENSP00000438583
MKQWKARLGCGLESGPMALEQNLSDLQLQAAVEVAGDLEVDCYRAPCSESQEELALQHFMKEKLLAELEGKLRVFENIVAVLNKEVEASHLALATSIHQSQLDRERILSLEQRVVELQQTLAQKDQALGKLEQSLRLMEEASFDGTFLWKITNVTRRCHESACGRTVSLFSPAFYTAKYGYKLCLRLYLNGDGTGKRTHLSLFIVIMRGEYDALLPWPFRNKVTFMLLDQNNREHAIDAFRPDLSSASFQRPQSETNVASGCPLFFPLSKLQSPKHAYVKDDTMFLKCIVETST

SEQ ID NO: 37549 - protein, 416 aa, Homo sapiens; identical to SEQ ID NO: 37547
  ENSP00000443183

SEQ ID NO: 37550 - protein, 470 aa, Homo sapiens
  ENSP00000262395
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 37551 - protein, 49 aa, Homo sapiens
  ENSP00000464097
MPGFDYKFLEKPKRRLLCPLCGKPMREPVQVSTCGHRFCDTCLQEFLRS

SEQ ID NO: 37552 - protein, 182 aa, Homo sapiens
  ENSP00000415789
MPGFDYKFLEKPKRRLLCPLCGKPMREPVQVSTCGHRFCDTCLQEFLSEGVFKCPEDQLPLDYAKFPHPYPQIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARM

SEQ ID NO: 37553 - protein, 53 aa, Homo sapiens
  ENSP00000466306
MPGFDYKFLEKPKRRLLCPLCGKPMREPVQVSTCGHRFCDTCLQEFLRSLQVP

SEQ ID NO: 37554 - protein, 437 aa, Homo sapiens
  ENSP00000438154
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESHEGMCPQESVYCENKCGARMMRRLLAQHATSECPKRTQPCTYCTKEFVFDTIQSHQYQCPRLPVACPNQCGVGTVAREDLPGHLKDSCNTALVLCPFKDSGCKHRCPKLAMARHVEESVKPHLAMMCALVSRQRQELQELRRELEELSVGSDGVLIWKIGSYGRRLQEAKAKPNLECFSPAFYTHKYGYKLQVSAFLNGNGSGEGTHLSLYIRVLPGAFDNLLEWPFARRGLSPFLGRADMPWCRSHSTRTEVPAQVLCPKSHKGVGIGEGERVVQRVCLEI

SEQ ID NO: 37555 - protein, 195 aa, Homo sapiens
  ENSP00000262396
MPGFDYKFLEKPKRRLLCPLCGKPMREPVQVSTCGHRFCDTCLQEFLSEGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKCEFCGCDFSGEAYESSLGFGYPKFISHQDIRKRNYVRDDAVFIRAAVELPRKILS

SEQ ID NO: 37556 - protein, 92 aa, Homo sapiens
  ENSP00000464583
  MOD_RES (1)..(1): Any amino acid
XFCDTCLQEFLSEGVFKCPEDQLPLDYAKVSPHCQEEAQAQSVALGGRSCWQPVGSGPVSTKSLGMVRLHKDLPRPGAGSTSIGPAYPLHPQ

SEQ ID NO: 37557 - protein, 48 aa, Homo sapiens
  ENSP00000465164
MKLSRRDLPAHLQHDCPKRRLKCEFCGCDFSGEAYESHEGMCPQESVY

SEQ ID NO: 37558 - protein, 90 aa, Homo sapiens
  ENSP00000468107
MKLSRRDLPAHLQHDCPKRRLKCEFCGCDFSGEAYESHEGMCPQESVYCENKCGARMMRRLLAQHATSECPKRTQPCTYCTKEFVFDTIQ

SEQ ID NO: 37559 - protein, 112 aa, Homo sapiens
  ENSP00000396602
EGVFKCPEDQLPLDYAKIYPDPELEVQVLGLPIRCIHSEEGCRWSGPLRHLQGHLNTCSFNVIPCPNRCPMKLSRRDLPAHLQHDCPKRRLKAMRVCAPRRVSTVRISVVPA

SEQ ID NO: 37560 - protein, 144 aa, Homo sapiens
  ENSP00000481248
MPGFDYKFLEKPKRRLLCPLCGKPMREPVQVSTCGHRFCDTCLQEFLSEGVFKWPFARRVTFSLLDQSDPGLAKPQHVTETFHPDPNWKNFQKPGTWRGSLDESSLGFGYPKFISHQDIRKRNYVRDDAVFIRAAVELPRKILS

SEQ ID NO: 37561 - protein, 557 aa, Homo sapiens
  ENSP00000261464
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 37562 - protein, 557 aa, Homo sapiens; identical to SEQ ID NO: 37561
  ENSP00000355971

SEQ ID NO: 37563 - protein, 557 aa, Homo sapiens; identical to SEQ ID NO: 37561
  ENSP00000336825

SEQ ID NO: 37564 - protein, 729 aa, Homo sapiens
  ENSP00000333984
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKSEKETAIDVEKKEPGKASETKQGTVKIAAQAAAKKDEKKEDSKKTKKPAEVEQPKGKKQEKKEKHVEPAKSPKKEHSVPSDKQVKAKTERAKEEIGAVSIKKAVPGKKEEKTTKTVEQEIRKEKSGKTSSILKDKEPIKGKEEKVPASLKEKEPETKKDEKMSKAGKEVKPKPPQLQGKKEEKPEPQIKKEAKPAISEKVQIHKQDIVKPEKTVSHGKPEEKVLKQVKAVTIEKTAKPKPTKKAEHREREPPSIKTDKPKPTPKGTSEVTESGKKKTEISEKESKEKADMKHLREEKVSTRKESLQLHNVTKAEKPARVSKDVEDVPASKKAKEGTEDVSPTKQKSPISFFQCVYLDGYNGYGFQFPFTPADRPGESSGQANSPGQKQQGQ

SEQ ID NO: 37565 - protein, 297 aa, Homo sapiens
  ENSP00000486095
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGQSPAIPPPLPTEQASRPTPASPALEGKYFFFS

SEQ ID NO: 37566 - protein, 151 aa, Homo sapiens
  ENSP00000354307
  MOD_RES (1)..(1): Any amino acid
XTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGFPGPGIRNSSYYCQYIKGQINAWNDLRTSLLPIPYLSCGKMCSNFNN

SEQ ID NO: 37567 - protein, 167 aa, Homo sapiens
  ENSP00000437684
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKEVGHSS

SEQ ID NO: 37568 - protein, 44 aa, Homo sapiens
  ENSP00000406768
  MOD_RES (1)..(1): Any amino acid
XIHKDKTEKQEKPERKIQTKDWSANSSTIRTLKLTQLKPIYICT

SEQ ID NO: 37569 - protein, 286 aa, Homo sapiens
  ENSP00000439281
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKGKHSEQEAAGGSKRILGKKHMQ

SEQ ID NO: 37570 - protein, 583 aa, Homo sapiens
  ENSP00000264029
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 37571 - protein, 37 aa, Homo sapiens
  ENSP00000477923
MPGRTWELCLLLLLGLGLGSQEALPPPCERTSPADLH

SEQ ID NO: 37572 - protein, 552 aa, Homo sapiens
  ENSP00000381020
MPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYCYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 37573 - protein, 222 aa, Homo sapiens
  ENSP00000362214
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRPSQGSHLPSCLSKEPLGRRNPLPTHFHPSPPGLHLSHQDSSSQRPLGCSLAWTEARDTSTQ

SEQ ID NO: 37574 - protein, 230 aa, Homo sapiens
  ENSP00000362205
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTSILLLLACIFLIKILAASALWAAAWHGQKPGTHPPSELDCGHDPGYQLQTLPGLRDT

SEQ ID NO: 37575 - protein, 219 aa, Homo sapiens
  ENSP00000342651
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRAERHVKEDDGRKSPGEVPPGTSPACILATWPPGLLVLLWQETTLPEHCFSWTLEAGTG

SEQ ID NO: 37576 - protein, 1024 aa, Homo sapiens
  ENSP00000261180
MGEDDAALRAGSRGLSDPWADSVGVRPRTTERHIAVHKRLVLAFAVSLVALLAVTMLAVLLSLRFDECGASATPGADGGPSGFPERGGNGSLPGSARRNHHAGGDSWQPEAGGVASPGTTSAQPPSEEEREPWEPWTQLRLSGHLKPLHYNLMLTAFMENFTFSGEVNVEIACRNATRYVVLHASRVAVEKVQLAEDRAFGAVPVAGFFLYPQTQVLVVVLNRTLDAQRNYNLKIIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVVRLYARPDAIRRGSGDYALHITKRLIEFYEDYFKVPYSLPKLDLLAVPKHPYAAMENWGLSIFVEQRILLDPSVSSISYLLDVTMVIVHEICHQWFGDLVTPVWWEDVWLKEGFAHYFEFVGTDYLYPGWNMEKQRFLTDVLHEVMLLDGLASSHPVSQEVLQATDIDRVFDWIAYKKGAALIRMLANFMGHSVFQRGLQDYLTIHKYGNAARNDLWNTLSEALKRNGKYVNIQEVMDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLARAGYLPQNIPLEIIRYLSEEKDFLPWHAASRALYPLDKLLDRMENYNIFNEYILKQVATTYIKLGWPKNNFNGSLVQASYQHEELRREVIMLACSFGNKHCHQQASTLISDWISSNRNRIPLNVRDIVYCTGVSLLDEDVWEFIWMKFHSTTAVSEKKILLEALTCSDDRNLLNRLLNLSLNSEVVLDQDAIDVIIHVARNPHGRDLAWKFFRDKWKILNTRYGEALFMNSKLISGVTEFLNTEGELKELKNFMKNYDGVAAASFSRAVETVEANVRWKMLYQDELFQWLGKALRH

SEQ ID NO: 37577 - protein, 194 aa, Homo sapiens
  ENSP00000447822
  MOD_RES (1)..(1): Any amino acid
XIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVGAALIRMLANFMGHSVFQRGLQDYLTIHKYGNAARNDLWNTLSEALKRNGKYVNIQEVMDQWTLQMGYPVITILGNT

SEQ ID NO: 37578 - protein, 811 aa, Homo sapiens
  ENSP00000479256
MEAARALRLLLVVCGCLALPPLAEPVCPERCDCQHPQHLLCTNRGLRVVPKTSSLPSPHDVLTYSLGGNFITNITAFDFHRLGQLRRLDLQYNQIRSLHPKTFEKLSRLEELYLGNNLLQALAPGTLAPLRKLRILYANGNEISRLSRGSFEGLESLVKLRLDGNALGALPDAVFAPLGNLLYLHLESNRIRFLGKNAFAQLGKLRFLNLSANELQPSLRHAATFAPLRSLSSLILSANNLQHLGPRIFQHLPRLGLLSLRGNQLTHLAPEAFWGLEALRELRLEGNRLSQLPTALLEPLHSLEALDLSGNELSALHPATFGHLGRLRELSLRNNALSALSGDIFAASPALYRLDLDGNGWTCDCRLRGLKRWMGDWHSQGRLLTVFVQCRHPPALRGKYLDYLDDQQLQNGSCADPSPSASLTADRRRQPLPTAAGEEMTPPAGLAEELPPQPQLQQQGRFLAGVAWDGAARELVGNRSALRLSRRGPGLQQPSPSVAAAAGPAPQSLDLHKKPQRGRPTRADPALAEPTPTASPGSAPSPAGDPWQRATKHRLGTEHQERAAQSDGGAGLPPLVSDPCDFNKFILCNLTVEAVGADSASVRWAVREHRSPRPLGGARFRLLFDRFGQQPKFHRFVYLPESSDSATLRELRGDTPYLVCVEGVLGGRVCPVAPRDHCAGLVTLPEAGSRGGVDYQLLTLALLTVNALLVLLALAAWASRWLRRKLRARRKGGAPVHVRHMYSTRRPLRSMGTGVSADFSGFQSHRPRTTVCALSEADLIEFPCDRFMDSAGGGAGGSLRREDRLLQRFAD

SEQ ID NO: 37579 - protein, 465 aa, Homo sapiens [sequence omitted]

SEQ ID NO: 37580 - protein, 164 aa, Homo sapiens
  ENSP00000400174
  MOD_RES (1)..(1): Any amino acid
XKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSDRQPEPGSLGRQEVSEVHPAEEEPARQPPALRRP

SEQ ID NO: 37581 - protein, 396 aa, Homo sapiens
  ENSP00000449583
MAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRGTIVTCEMKTFVSPEAISPDLVKKIRDFHRKILTLPEMMRMFSENLAHHLEIDSGVITLDPQTASRSLVLSEDRKSVRYTRQKKSLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 37582 - protein, 465 aa, Homo sapiens [sequence omitted]

SEQ ID NO: 37583 - protein, 164 aa, Homo sapiens; identical to SEQ ID NO: 37580
  ENSP00000389858
  MOD_RES (1)..(1): Any amino acid

SEQ ID NO: 37584 - protein, 396 aa, Homo sapiens; identical to SEQ ID NO: 37581
  ENSP00000447232

SEQ ID NO: 37585 - protein, 115 aa, Homo sapiens
  ENSP00000447500
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCTSECRTTDGFGCA

SEQ ID NO: 37586 - protein, 465 aa, Homo sapiens
  ENSP00000409605
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEAISPDLVKKIRDFHRKILTLPEMMRMFSENLAHHLEIDSGVITLDPQTASRSLVLSEDRKSVRYTRQKKNLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 37587 - protein, 164 aa, Homo sapiens; identical to SEQ ID NO: 37580
  ENSP00000403836
  MOD_RES (1)..(1): Any amino acid

SEQ ID NO: 37588 - protein, 115 aa, Homo sapiens; identical to SEQ ID NO: 37585
  ENSP00000449686

SEQ ID NO: 37589 - protein, 396 aa, Homo sapiens
  ENSP00000448772
MAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRGTIVTCEMKTFVSPEAISPDLVKKIRDFHRKILTLPEMMRMFSENLAHHLEIDSGVITLDPQTASRSLVLSEDRKSVRYTRQKKNLPDSPLRFDGLPAVLGFPGFSSGRHRWQVDLQLGDGGGCTVGVAGEGVRRKGEMGLSAEDGVWAVIISHQQCWASTSPGTDLPLSEIPRGVRVALDYEAGQVTLHNAQTQEPIFTFTASFSGKVFPFFAVWKKGSCLTLKG

SEQ ID NO: 37590 - protein, 465 aa, Homo sapiens [sequence omitted]

SEQ ID NO: 37591 - protein, 164 aa, Homo sapiens; identical to SEQ ID NO: 37580
  ENSP00000392768
  MOD_RES (1)..(1): Any amino acid

SEQ ID NO: 37592 - protein, 396 aa, Homo sapiens; identical to SEQ ID NO: 37581
  ENSP00000447725

SEQ ID NO: 37593 - protein, 465 aa, Homo sapiens [sequence omitted]

SEQ ID NO: 37594 - protein, 164 aa, Homo sapiens; identical to SEQ ID NO: 37580
  ENSP00000398285
  MOD_RES (1)..(1): Any amino acid

SEQ ID NO: 37595 - protein, 115 aa, Homo sapiens; identical to SEQ ID NO: 37585
  ENSP00000365878

SEQ ID NO: 37596 - protein, 396 aa, Homo sapiens; identical to SEQ ID NO: 37581
  ENSP00000484001

SEQ ID NO: 37597 - protein, 465 aa, Homo sapiens [sequence omitted]

SEQ ID NO: 37598 - protein, 164 aa, Homo sapiens; identical to SEQ ID NO: 37580
  ENSP00000412755
  MOD_RES (1)..(1): Any amino acid

SEQ ID NO: 37599 - protein, 396 aa, Homo sapiens; identical to SEQ ID NO: 37581
  ENSP00000450011

SEQ ID NO: 37600 - protein, 465 aa, Homo sapiens; identical to SEQ ID NO: 37586
  ENSP00000398224

SEQ ID NO: 37601 - protein, 164 aa, Homo sapiens; identical to SEQ ID NO: 37580
  ENSP00000402326
  MOD_RES (1)..(1): Any amino acid

SEQ ID NO: 37602 - protein, 396 aa, Homo sapiens; identical to SEQ ID NO: 37589
  ENSP00000447004

SEQ ID NO: 37603 - protein, 115 aa, Homo sapiens; identical to SEQ ID NO: 37585
  ENSP00000449617

SEQ ID NO: 37604 - protein, 465 aa, Homo sapiens [sequence omitted]

SEQ ID NO: 37605 - protein, 164 aa, Homo sapiens; identical to SEQ ID NO: 37580
  ENSP00000391673
  MOD_RES (1)..(1): Any amino acid

SEQ ID NO: 37606 - protein, 396 aa, Homo sapiens; identical to SEQ ID NO: 37581
  ENSP00000448307

SEQ ID NO: 37607 - protein, 138 aa, Homo sapiens
  ENSP00000400879
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMC

SEQ ID NO: 37608 - protein, 744 aa, Homo sapiens
  ENSP00000415812
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 37609 - protein, 526 aa, Homo sapiens
  ENSP00000488229
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVDGVLQAEVQWHDLSPLQPLPPGFKQFSCLGLLSSWDYRHAPPCSANFLYF

SEQ ID NO: 37610 - protein, 771 aa, Homo sapiens
  ENSP00000339659
MHRSGRYGTQQQRAGSKTAGPPCQWSRMASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQKASIVDDIHSTFDELQKTLNVRKSVLLMELEVNYGLKHKVLQSQLDTLLQGQESIKSCSNFTAQALNHGTETEVLLVKKQMSEKLNELADQDFPLHPRENDQLDFIVETEGLKKSIHNLGTILTTNAVASETVATGEGLRQTIIGQPMSVTITTKDKDGELCKTGNAYLTAELSTPDGSVADGEILDNKNGTYEFLYTVQKEGDFTLSLRLYDQHIRGSPFKLKVIRSADVSPTTEGVKRRVKSPGSGHVKQKAVKRPASMYSTGKRKENPIEDDLIFRVGTKGRNKGEFTNLQGVAASTNGKILIADSNNQCVQIFSNDGQFKSRFGIRGRSPGQLQRPTGVAVHPSGDIIIADYDNKWVSIFSSDGKFKTKIGSGKLMGPKGVSVDRNGHIIVVDNKACCVFIFQPNGKIVTRFGSRGNGDRQFAGPHFAAVNSNNEIIITDFHNHSVKVFNQEGEFMLKFGSNGEGNGQFNAPTGVAVDSNGNIIVADWGNSRIQVFDGSGSFLSYINTSADPLYGPQGLALTSDGHVVVADSGNHCFKVYRYLQ

SEQ ID NO: 37611 - protein, 136 aa, Homo sapiens
  ENSP00000487836
MASEGTNIPSPVVRQIDKQFLICSICLERYKNPKVLPCLHTFCERCLQNYIPAHSLTLSCPVCRQTSILPEKGVAALQNNFFITNLMDVLQRTPGSNAEESSILETVTAVAAGKPLSCPNHDGNVSGWDGRYCPGA

SEQ ID NO: 37612 - protein, 44 aa, Homo sapiens
  ENSP00000488602
MASEGTNIPSPVVRQIDKQFLICSICLERYKNPKVLPCLHTFCE

SEQ ID NO: 37613 - protein, 136 aa, Homo sapiens; identical to SEQ ID NO: 37611
  ENSP00000487750

SEQ ID NO: 37614 - protein, 110 aa, Homo sapiens
  ENSP00000400375
MDVLQRTPGSNAEESSILETVTAVAAGKPLSCPNHDGNVMEFYCQSCETAMCRECTEGEHAEHPTVPLKDVVEQHKASLQVQLDAVNKRLPEIDSALQFISEIIHQLTNQ

SEQ ID NO: 37615 - protein, 114 aa, Homo sapiens
  ENSP00000488751
  MOD_RES (1)..(1): Any amino acid
XKIGSGKLMGPKGVSVDRNGHIIVVDNKACCVFIFQPNGKIVTRFGSRGNGDRQFAGPHFAAVNSNNEIIITDFHNHSVKVLQAHELLLTFNCFYGEIGLRENNAILTYGTKGS

SEQ ID NO: 37616 - protein, 539 aa, Homo sapiens
  ENSP00000409182
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQPAAELMQDTRDFLNRYPRKKFWVGKPIARVVKKKTGEFSDKLLSLQRGLREFQGKLLRDLEYKTVSVTLDPQSASGYLQLSEDWKCVTYTSLYKSAYLHPQQFDCEPGVLGSKGFTWGKVYWEVEVEREGWSEDEEEGDEEEEGEEEEEEEEAGYGDGYDDWETDEDEESLGDEEEEEEEEEEEVLESCMVGVARDSVKRKGDLSLRPEDGVWALRLSSSGIWANTSPEAELFPALRPRRVGIALDYEGGTVTFTNAESQELIYTFTATFTRRLVPFLWLKWPGTRLLLRP

SEQ ID NO: 37617 - protein, 539 aa, Homo sapiens; identical to SEQ ID NO: 37616
  ENSP00000392805

SEQ ID NO: 37618 - protein, 539 aa, Homo sapiens; identical to SEQ ID NO: 37616
  ENSP00000390258

SEQ ID NO: 37619 - protein, 248 aa, Homo sapiens
  ENSP00000402135
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLRRDRDKIQGFQAKGEADILAALKKLQDQRQYIVAEFEQGHQFLREREEHLLEQLAKLEQELTEGREKFKSRGVGELARLALVISELEGKAQQ

SEQ ID NO: 37620 - protein, 159 aa, Homo sapiens
  ENSP00000393753
MATSAPLRSLEEEVTCSICLDYLRDPVTIDCGHVFCRSCTTDVRPISGSRPVCPLCKKPFKKENIRPVWQLEKILNHLSTLRRDRDKIQGFQAKGEADILAALKKLQDQRQYIVAEFEQGHQFLREREEHLLEQLAKLEQELTEGREKFKSRGVGELAR

SEQ ID NO: 37621 - protein, 157 aa, Homo sapiens
  ENSP00000412641
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCVMCRESREHRPHTAVLMEKAAQPHREKILNHLSTLR

SEQ ID NO: 37622 - protein, 122 aa, Homo sapiens
  ENSP00000405923
MATSAPLRSLEEEVTCSICLDYLRDPVTIDCGHVFCRSCTTDVRPISGSRPVCPLCKKPFKKENIRPVWQLASLVENIERLKVDKGRQPGEVTREQQDAKLCERHREKLHYYCEDDGKLLCV

SEQ ID NO: 37623 - protein, 539 aa, Homo sapiens; identical to SEQ ID NO: 37616
  ENSP00000394421

SEQ ID NO: 37624 - protein, 539 aa, Homo sapiens; identical to SEQ ID NO: 37616
  ENSP00000415755

SEQ ID NO: 37625 - protein, 539 aa, Homo sapiens; identical to SEQ ID NO: 37616
  ENSP00000414248

SEQ ID NO: 37626 - protein, 248 aa, Homo sapiens; identical to SEQ ID NO: 37619
  ENSP00000391602

SEQ ID NO: 37627 - protein, 159 aa, Homo sapiens; identical to SEQ ID NO: 37620
  ENSP00000416276

SEQ ID NO: 37628 - protein, 157 aa, Homo sapiens; identical to SEQ ID NO: 37621
  ENSP00000391031

SEQ ID NO: 37629 - protein, 122 aa, Homo sapiens; identical to SEQ ID NO: 37622
  ENSP00000388005

SEQ ID NO: 37630 - protein, 539 aa, Homo sapiens; identical to SEQ ID NO: 37616
  ENSP00000394371

SEQ ID NO: 37631 - protein, 539 aa, Homo sapiens; identical to SEQ ID NO: 37616
  ENSP00000407876

SEQ ID NO: 37632 - protein, 539 aa, Homo sapiens; identical to SEQ ID NO: 37616
  ENSP00000416737

SEQ ID NO: 37633 - protein, 248 aa, Homo sapiens; identical to SEQ ID NO: 37619
  ENSP00000389386

SEQ ID NO: 37634 - protein, 157 aa, Homo sapiens; identical to SEQ ID NO: 37621
  ENSP00000405710

SEQ ID NO: 37635 - protein, 122 aa, Homo sapiens; identical to SEQ ID NO: 37622
  ENSP00000403765

SEQ ID NO: 37636 - protein, 159 aa, Homo sapiens; identical to SEQ ID NO: 37620
  ENSP00000400655

SEQ ID NO: 37637 - protein, 539 aa, Homo sapiens; identical to SEQ ID NO: 37616
  ENSP00000395491

SEQ ID NO: 37638 - protein, 539 aa, Homo sapiens; identical to SEQ ID NO: 37616
  ENSP00000410446

SEQ ID NO: 37639 - protein, 539 aa, Homo sapiens; identical to SEQ ID NO: 37616
  ENSP00000391879

SEQ ID NO: 37640 - protein, 248 aa, Homo sapiens; identical to SEQ ID NO: 37619
  ENSP00000413673

SEQ ID NO: 37641 - protein, 157 aa, Homo sapiens; identical to SEQ ID NO: 37621
  ENSP00000387530

SEQ ID NO: 37642 - protein, 122 aa, Homo sapiens; identical to SEQ ID NO: 37622
  ENSP00000400920

SEQ ID NO: 37643 - protein, 539 aa, Homo sapiens; identical to SEQ ID NO: 37616
  ENSP00000373102

SEQ ID NO: 37644 - protein, 539 aa, Homo sapiens; identical to SEQ ID NO: 37616
  ENSP00000331131

SEQ ID NO: 37645 - protein, 539 aa, Homo sapiens; identical to SEQ ID NO: 37616
  ENSP00000379806

SEQ ID NO: 37646 - protein, 248 aa, Homo sapiens; identical to SEQ ID NO: 37619
  ENSP00000390908

SEQ ID NO: 37647 - protein, 157 aa, Homo sapiens; identical to SEQ ID NO: 37621
  ENSP00000412165

SEQ ID NO: 37648 - protein, 122 aa, Homo sapiens; identical to SEQ ID NO: 37622
  ENSP00000405526

SEQ ID NO: 37649 - protein, 539 aa, Homo sapiens; identical to SEQ ID NO: 37616
  ENSP00000396188

SEQ ID NO: 37650 - protein, 539 aa, Homo sapiens; identical to SEQ ID NO: 37616
  ENSP00000407294

SEQ ID NO: 37651 - protein, 539 aa, Homo sapiens; identical to SEQ ID NO: 37616
  ENSP00000398545

SEQ ID NO: 37652 - protein, 248 aa, Homo sapiens; identical to SEQ ID NO: 37619
  ENSP00000395820

SEQ ID NO: 37653 - protein, 159 aa, Homo sapiens; identical to SEQ ID NO: 37620
  ENSP00000403395

SEQ ID NO: 37654 - protein, 157 aa, Homo sapiens; identical to SEQ ID NO: 37621
  ENSP00000407035

SEQ ID NO: 37655 - protein, 122 aa, Homo sapiens; identical to SEQ ID NO: 37622
  ENSP00000396089

SEQ ID NO: 37656 - protein, 539 aa, Homo sapiens; identical to SEQ ID NO: 37616
  ENSP00000402395

SEQ ID NO: 37657 - protein, 539 aa, Homo sapiens; identical to SEQ ID NO: 37616
  ENSP00000408233

SEQ ID NO: 37658 - protein, 539 aa, Homo sapiens; identical to SEQ ID NO: 37616
  ENSP00000406707

SEQ ID NO: 37659 - protein, 248 aa, Homo sapiens; identical to SEQ ID NO: 37619
  ENSP00000397048

SEQ ID NO: 37660 - protein, 159 aa, Homo sapiens; identical to SEQ ID NO: 37620
  ENSP00000402684

SEQ ID NO: 37661 - protein, 157 aa, Homo sapiens; identical to SEQ ID NO: 37621
  ENSP00000402990

SEQ ID NO: 37662 - protein, 122 aa, Homo sapiens; identical to SEQ ID NO: 37622
  ENSP00000393827

SEQ ID NO: 37663 - protein, 539 aa, Homo sapiens; identical to SEQ ID NO: 37616
  ENSP00000393011

SEQ ID NO: 37664 - protein, 539 aa, Homo sapiens; identical to SEQ ID NO: 37616
  ENSP00000389203

SEQ ID NO: 37665 - protein, 539 aa, Homo sapiens; identical to SEQ ID NO: 37616
  ENSP00000415328

SEQ ID NO: 37666 - protein, 248 aa, Homo sapiens; identical to SEQ ID NO: 37619
  ENSP00000412838

SEQ ID NO: 37667 - protein, 157 aa, Homo sapiens; identical to SEQ ID NO: 37621
  ENSP00000416664

SEQ ID NO: 37668 - protein, 122 aa, Homo sapiens; identical to SEQ ID NO: 37622
  ENSP00000403887

SEQ ID NO: 37669 - protein, 159 aa, Homo sapiens; identical to SEQ ID NO: 37620
  ENSP00000405791

SEQ ID NO: 37670 - protein, 493 aa, Homo sapiens
  ENSP00000369373
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWVDVTVAPNNISCAVISEDKRQVSSPKPQIIYGARGTRYQTFVNFNYCTGILGSQSITSGKHYWEVDVSKKTAWILGVCAGFQPDAMCNIEKNENYQPKYGYWVIGLEEGVKCSAFQDSSFHTPSVPFIVPLSVIICPDRVGVFLDYEACTVSFFNITNHGFLIYKFSHCSFSQPVFPYLNPRKCGVPMTLCSPSS

SEQ ID NO: 37671 - protein, 326 aa, Homo sapiens
  ENSP00000369366
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGWSAMARSRFTATSTSQIQAILLPQPPK

SEQ ID NO: 37672 - protein, 271 aa, Homo sapiens
  ENSP00000393052
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQDGERDLEEARNFSKKSKESVSSS

SEQ ID NO: 37673 - protein, 347 aa, Homo sapiens
  ENSP00000380058
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRTENVTLKKPETFPKNQRRVFRAPDLKGMLEVFRELTDVRRYWGKEKSHYHKPPCGLSLLLSLSFRILCSLLGSCFKIYDSPSKTHITYPSL

SEQ ID NO: 37674 - protein, 187 aa, Homo sapiens
  ENSP00000398196
  MOD_RES (1)..(1): Any amino acid
XGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQGVDGVIKRADRCPTLLGLECNGTISVHCNLHLSDSSNSPASASQVAGITGAHHHPWLNLYFQ

SEQ ID NO: 37675 - protein, 209 aa, Homo sapiens
  ENSP00000388031
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEED

SEQ ID NO: 37676 - protein, 72 aa, Homo sapiens
  ENSP00000388150
MASGILVNVKEEVTCPICLELLTQPLSLDCGHSFCQACLTANHKKSMLDKGESSCPVCRISYQPENIRPNRH

SEQ ID NO: 37677 - protein, 728 aa, Homo sapiens
  ENSP00000282369
MSESGEMSEFGYIMELIAKGKVTIKNIERELICPACKELFTHPLILPCQHSICHKCVKELLLTLDDSFNDVGSDNSNQSSPRLRLPSPSMDKIDRINRPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 37678 - protein, 716 aa, Homo sapiens
  ENSP00000423934
MEGDGSDSPVTIKNIERELICPACKELFTHPLILPCQHSICHKCVKELLLTLDDSFNDVGSDNSNQSSPRLRLPSPSMDKIDRINRPGWKRNSLTPRTTVFPCPGCEHDVDLGERGINGLFRNFTLETIVERYRQAARAATAIMCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 37679 - protein, 573 aa, Homo sapiens
  ENSP00000424259
MCDLCKPPPQESTKSCMDCSASYCNECFKIHHPWGTIKAQHEYVGPTTNFRPKILMCPEHETERINMYCELCRRPVCHLCKLGGNHANHRVTTMSSAYKTLKEKLSKDIDYLIGKESQVKSQISELNLLMKETECNGERAKEEAITHFEKLFEVLEERKSSVLKAIDSSKKLRLDKFQTQMEEYQGLLENNGLVGYAQEVLKETDQSCFVQTAKQLHLRIQKATESLKSFRPAAQTSFEDYVVNTSKQTELLGELSFFSSGIDVPEINEEQSKVYNNALINWHHPEKDKADSYVLEYRKINRDDEMSWNEIEVCGTSKIIQDLENSSTYAFRVRAYKGSICSPCSRELILHTPPAPVFSFLFDEKCGYNNEHLLLNLKRDRVESRAGFNLLLAAERIQVGYYTSLDYIIGDTGITKGKHFWAFRVEPYSYLVKVGVASSDKLQEWLRSPRDAVSPRYEQDSGHDSGSEDACFDSSQPFTLVTIGMQKFFIPKSPTSSNEPENRVLPMPTSIGIFLDCDKGKVDFYDMDQMKCLYERQVDCSHTLYPAFALMGSGGIQLEEPITAKYLEYQEDM

SEQ ID NO: 37680 - protein, 170 aa, Homo sapiens
  ENSP00000424743
MEGDGSDSPVTIKNIERELICPACKELFTHPLILPCQHSICHKCVKELLLTLDDSFNDVGSDNSNQSSPRLRLPSPSMDKIDRINRPASQRRSVGWRGWKRNSLTPRTTVFPCPGCEHDVDLGERGINGLFRNFTLETIVERYRQAARAATAIMCDLCKPPPQESTKSCM

SEQ ID NO: 37681 - protein, 60 aa, Homo sapiens
  ENSP00000368938
MSESGEMSEFGYIMELIAKGKMPDWRRGYRCRQGCGKTTELATATDFSQTGNKSGKHFKT

SEQ ID NO: 37682 - protein, 61 aa, Homo sapiens
  ENSP00000368937
MSESGEMSEFGYIMELIAKGKASAMGLQQTHEHSRLTSKGGEARCPFEISEVGKQSLPRRT

SEQ ID NO: 37683 - protein, 323 aa, Homo sapiens
  ENSP00000444313
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPDEGTDK

SEQ ID NO: 37684 - protein, 68 aa, Homo sapiens
  ENSP00000420451
MVQPSLEMHNFEEELTCPICYSIFEDPRVLPCSHTFCRNCLENILQASGNFYIWRPLRIPLKCPNCRS

SEQ ID NO: 37685 - protein, 111 aa, Homo sapiens
  ENSP00000417605
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLL

SEQ ID NO: 37686 - protein, 114 aa, Homo sapiens
  ENSP00000418699
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKK

SEQ ID NO: 37687 - protein, 179 aa, Homo sapiens
  ENSP00000418856
MRRRIRIKDSGGVGEECIQPPNHEINKEMHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQ

SEQ ID NO: 37688 - protein, 155 aa, Homo sapiens
  ENSP00000420520
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDT

SEQ ID NO: 37689 - protein, 177 aa, Homo sapiens
  ENSP00000417081
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKM

SEQ ID NO: 37690 - protein, 403 aa, Homo sapiens
  ENSP00000311219
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPGKDEKEVEFLKILNIVVVTLISVILMSILFFNQHIITFLSEITLIWFSEASLSVYQSLSNSLHKVKNILCHIFYLLKEFVWKIVSH

SEQ ID NO: 37691 - protein, 475 aa, Homo sapiens
  ENSP00000291416
MACSLKDELLCSICLSIYQDPVSLGCEHYFCRRCITEHWVRQEAQGARDCPECRRTFAEPALAPSLKLANIVERYSSFPLDAILNARRAARPCQAHDKVKLFCLTDRALLCFFCDEPALHEQHQVTGIDDAFDELQRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQPSRGFYCIVMHDGNQYSACTEPWTRLNVRDKLDKVGVFLDYDQGLLIFYNADDMSWLYTFREKFPGKLCSYFSPGQSHANGKNVQPLRINTVRI

SEQ ID NO: 37692 - protein, 354 aa, Homo sapiens
  ENSP00000441173
MPEKTAVDQPWTQALRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVPAALTLDPGTAHQRLILSDDCTIVAYGNLHPQPLQDSPKRFDVEVSVLGSEAFSSGVHYWEVVVAEKTQWVIGLAHEAASRKGSIQIQPSRGFYCIVMHDGNQYSACTEPWTRLNVRDKLDKVGVFLDYDQGLLIFYNADDMSWLYTFREKFPGKLCSYFSPGQSHANGKNVQPLRINTVRI

SEQ ID NO: 37693 - protein, 781 aa, Homo sapiens
  ENSP00000412124
MEEELKCPVCGSLFREPIILPCSHNVCLPCARTIAVQTPDGEQHLPQPLLLSRGSGLQAGAAAAASLEHDAAAGPACGGAGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLVQPPPPPPPPAEAASGPTGTAQGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKLPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHVDGVFMPALSLNRNVQVTLHTGLEVPTNLGRPKLSGN

SEQ ID NO: 37694 - protein, 721 aa, Homo sapiens
  ENSP00000400163
MEEELKCPVCGSLFREPIILPCSHNVCLPCARTIAVQTPDGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKCRVPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHVDGVFMPALSLNRNVQVTLHTGLEVPTNLGRPKLSGN

SEQ ID NO: 37695 - protein, 783 aa, Homo sapiens
  ENSP00000355613
MEEELKCPVCGSLFREPIILPCSHNVCLPCARTIAVQTPDGEQHLPQPLLLSRGSGLQAGAAAAASLEHDAAAGPACGGAGGSAAGGLGGGAGGGGDHADKLSLYSETDSGYGSYTPSLKSPNGVRVLPMVPAPPGSSAAAARGAACSSLSSSSSSITCPQCHRSASLDHRGLRGFQRNRLLEAIVQRYQQGRGAVPGTSAAAAVAICQLCDRTPPEPAATLCEQCDVLYCSACQLKCHPSRGPFAKHRLVQPPPPPPPPAEAASGPTGTAQGAPSGGGGCKSPGGAGAGATGGSTARKFPTCPEHEMENYSMYCVSCRTPVCYLCLEEGRHAKHEVKPLGAMWKQHKAQLSQALNGVSDKAKEAKEFLVQLKNILQQIQENGLDYEACLVAQCDALVDALTRQKAKLLTKVTKEREHKLKMVWDQINHCTLKLRQSTGLMEYCLEVIKENDPSGFLQISDALIKRVQVSQEQWVKGALEPKVSAEFDLTLDSEPLLQAIHQLDFIQMKCRVPPVPLLQLEKCCTRNNSVTLAWRMPPFTHSPVDGYILELDDGAGGQFREVYVGKETLCTIDGLHFNSTYNARVKAFNSSGVGPYSKTVVLQTSDVAWFTFDPNSGHRDIILSNDNQTATCSSYDDRVVLGTAAFSKGVHYWELHVDRYDNHPDPAFGVARASVVKDMMLGKDDKAWAMYVDNNRSWFMHCNSHTNRTEGGVCKGATVGVLLDLNKHTLTFFINGQQQGPTAFSHVDGVFMPALSLNRNVQVTLHTGLEVPTNLGRPKLSGN

SEQ ID NO: 37696 - protein, 236 aa, Homo sapiens
  ENSP00000346564
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLKVETESDRGEVTCLRSQLVSGEAKIGTQAIQLGRTKDGVSETSPASALLLAFSLIQTWLQPLGWDWPPYLPFNPVLPCCQKELSRKHMSPQPSLAGTQPLQETKLPPTDHRTSKTHHRHLLLFLP

SEQ ID NO: 37697 - protein, 189 aa, Homo sapiens
  ENSP00000379009
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 37698 - protein, 189 aa, Homo sapiens; identical to SEQ ID NO: 37697
  ENSP00000436152

SEQ ID NO: 37699 - protein, 189 aa, Homo sapiens; identical to SEQ ID NO: 37697
  ENSP00000433474

SEQ ID NO: 37700 - protein, 64 aa, Homo sapiens
  ENSP00000437243
MAAKQPPPLMKKHSQTDLVSRLKTRKILGVGGEDDDGEVHRSKGLAVRLCCALLRHCHHGACLP

SEQ ID NO: 37701 - protein, 158 aa, Homo sapiens
  ENSP00000433454
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMS

SEQ ID NO: 37702 - protein, 91 aa, Homo sapiens
  ENSP00000437258
MAAKQPPPLMKKHSQTDLVSRLKTRKILGVGGEDDDGEVHRSKGLAVRLCCALLRHCHHGISLIMWNALYTAEKVIIRWTLLTEACYFGVQ

SEQ ID NO: 37703 - protein, 154 aa, Homo sapiens
  ENSP00000475501
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLNAAPTPRPLMKLSAGDVLPSCGHWWNTPSGLELAVATICKERS

SEQ ID NO: 37704 - protein, 126 aa, Homo sapiens
  ENSP00000435800
MAAKQPPPLMKKHSQTDLVSRLKTRKILGVGGEDDDGEVHRSKISQVLGNEIKFTIREPLGLRVWQFVSAVLFSGIAIMVSPHPQPLRSGPVWLPQPFSGSPEVPPPSWPLVQGPICQALGLPPRT

SEQ ID NO: 37705 - protein, 98 aa, Homo sapiens
  ENSP00000434461
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVT

SEQ ID NO: 37706 - protein, 123 aa, Homo sapiens
  ENSP00000435739
MPPSCHLLCPDLSPSSAHPSAEAGLEEKMAAKQPPPLMKKHSQTDLVSRLKTRKILGVGGEDDDGEVHRSKISQVLGNEIKFTIREPLGLRVWQFVSAVLFSGIAIMALAFPDQLYDAVFDGA

SEQ ID NO: 37707 - protein, 93 aa, Homo sapiens
  ENSP00000437284
MAAKQPPPLMKKHSQTDLVSRLKTRKILGVGGEDDDGEVHRSKISQVLGNEIKFTIREPLGLRVWQFVSAVLFSGIAIMALAFPDQLYDAVFD

SEQ ID NO: 37708 - protein, 79 aa, Homo sapiens
  ENSP00000432089
MAAKQPPPLMKKHSQTDLVSRLKTRKILGVGGEDDDGEVHRSKISQVLGNEIKFTIREPLGLRVWQFVSAVLFSGIAIM

SEQ ID NO: 37709 - protein, 73 aa, Homo sapiens
  ENSP00000431556
MAAKQPPPLMKKHSQTDLVSRLKTRKILGVGGEDDDGEVHRSKISQVLGNEIKFTIREPLGLRVWQFVSAVLF

SEQ ID NO: 37710 - protein, 62 aa, Homo sapiens
  ENSP00000432926
MAAKQPPPLMKKHSQTDLVSRLKTRKILGVGGEDDDGEVHRSKISQVLGNEIKFTIREPLGL

SEQ ID NO: 37711 - protein, 189 aa, Homo sapiens; identical to SEQ ID NO: 37697
  ENSP00000481456

SEQ ID NO: 37712 - protein, 189 aa, Homo sapiens; identical to SEQ ID NO: 37697
  ENSP00000309532

SEQ ID NO: 37713 - protein, 64 aa, Homo sapiens; identical to SEQ ID NO: 37700
  ENSP00000486799

SEQ ID NO: 37714 - protein, 848 aa, Homo sapiens
  ENSP00000264811
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 37715 - protein, 921 aa, Homo sapiens
  ENSP00000368966
MSTKVRKCKEQARVTFPAPEEEEDEGEDEGAEPQRRRRGWRGVNGGLEPRSAPSQREPHGYCPPPFSHGPDLSMEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 37716 - protein, 276 aa, Homo sapiens
  ENSP00000423866
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKISEQVENSKFRLETVEKHLE

SEQ ID NO: 37717 - protein, 793 aa, Homo sapiens
  ENSP00000426899
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 37718 - protein, 93 aa, Homo sapiens
  ENSP00000422214
MEGSPSLRRMTVMREKGRRQAVRGPAFMFNDRGTSLTAEEERFLDAAEYGNIPVVRKMLEESKTLNVNCVDYMGQNALQLAVGNEHLEVTELL

SEQ ID NO: 37719 - protein, 973 aa, Homo sapiens
  ENSP00000262839
MAQLYYKKVNYSPYRDRIPLQIVRAETELSAEEKAFLNAVEKGDYATVKQALQEAEIYYNVNINCMDPLGRSALLIAIENENLEIMELLLNHSVYVGDALLYAIRKEVVGAVELLLSYRRPSGEKQVPTLMMDTQFSEFTPDITPIMLAAHTNNYEIIKLLVQKRVTIPRPHQIRCNCVECVSSSEVDSLRHSRSRLNIYKALASPSLIALSSEDPILTAFRLGWELKELSKVENEFKAEYEELSQQCKLFAKDLLDQARSSRELEIILNHRDDHSEELDPQKYHDLAKLKVAIKYHQKEFVAQPNCQQLLATLWYDGFPGWRRKHWVVKLLTCMTIGFLFPMLSIAYLISPRSNLGLFIKKPFIKFICHTASYLTFLFMLLLASQHIVRTDLHVQGPPPTVVEWMILPWVLGFIWGEIKEMWDGGFTEYIHDWWNLMDFAMNSLYLATISLKIVAYVKYNGSRPREEWEMWHPTLIAEALFAISNILSSLRLISLFTANSHLGPLQISLGRMLLDILKFLFIYCLVLLAFANGLNQLYFYYETRAIDEPNNCKGIRCEKQNNAFSTLFETLQSLFWSVFGLLNLYVTNVKARHEFTEFVGATMFGTYNVISLVVLLNMLIAMMNNSYQLIADHADIEWKFARTKLWMSYFDEGGTLPPPFNIIPSPKSFLYLGNWFNNTFCPKRDPDGRRRRRNLRSFTERNADSLIQNQHYQEVIRNLVKRYVAAMIRNSKTHEGLTEENFKELKQDISSFRYEVLDLLGNRKHPRSFSTSSTELSQRDDNNDGSGGARAKSKSVSFNLGCKKKTCHGPPLIRTMPRSSGAQGKSKAESSSKRSFMGPSLKKLGLLFSKFNGHMSEPSSEPMYTISDGIVQQHCMWQDIRYSQMEKGKAEACSQSEINLSEVELGEVQGAAQSSECPLACSSSLHCASSICSSNSKLLDSSEDVFETWGEACDLLMHKWGDGQEEQVTTRL

SEQ ID NO: 37720 - protein, 931 aa, Homo sapiens
  ENSP00000340913
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 37721 - protein, 853 aa, Homo sapiens
  ENSP00000435574
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 37722 - protein, 815 aa, Homo sapiens
  ENSP00000343672
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 37723 - protein, 876 aa, Homo sapiens
  ENSP00000353687
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 37724 - protein, 807 aa, Homo sapiens
  ENSP00000424854
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 37725 - protein, 801 aa, Homo sapiens
  ENSP00000367720
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 37726 - protein, 746 aa, Homo sapiens
  ENSP00000330322
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 37727 - protein, 261 aa, Homo sapiens
  ENSP00000426870
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKE

SEQ ID NO: 37728 - protein, 862 aa, Homo sapiens
  ENSP00000426070
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 37729 - protein, 380 aa, Homo sapiens
  ENSP00000421571
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKVQTA

SEQ ID NO: 37730 - protein, 1503 aa, Homo sapiens
  ENSP00000300482
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 37731 - protein, 143 aa, Homo sapiens
  ENSP00000393982
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYV

SEQ ID NO: 37732 - protein, 1503 aa, Homo sapiens; identical to SEQ ID NO: 37730
  ENSP00000381023

SEQ ID NO: 37733 - protein, 1553 aa, Homo sapiens
  ENSP00000381026
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKAGLELWGSRTSSVCKSRQFLHLTVVESRGSEKAPVTTLACLQGCLGKHGRVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 37734 - protein, 1449 aa, Homo sapiens
  ENSP00000300481
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGENPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 37735 - protein, 247 aa, Homo sapiens [sequence omitted]

SEQ ID NO: 37736 - protein, 339 aa, Homo sapiens
  ENSP00000371338
  MOD_RES (1)..(1): Any amino acid
XGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVLVPRLPRAGHGPGLGEHALLYAGFPVHGHVQRHDPEGHFA

SEQ ID NO: 37737 - protein, 146 aa, Homo sapiens
  ENSP00000460856
  MOD_RES (1)..(1): Any amino acid
XEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFLGLADREVSQRQQGLQLLRQLQRRSAGTLQAHHRPG

SEQ ID NO: 37738 - protein, 791 aa, Homo sapiens
  ENSP00000301365
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTADFNKIQDSSRNNSKTTLNAFEEVEEFPETSV

SEQ ID NO: 37739 - protein, 55 aa, Homo sapiens
  ENSP00000458187
MKAHPKEMVPLMGKRVAAPSGNPAILPEKRPAEITPTKKSRHRVLPHWPQTPDLN

SEQ ID NO: 37740 - protein, 55 aa, Homo sapiens; identical to SEQ ID NO: 37739
  ENSP00000458239

SEQ ID NO: 37741 - protein, 790 aa, Homo sapiens
  ENSP00000461518
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTDFNKIQDSSRNNSKTTLNAFEEVEEFPETSV

SEQ ID NO: 37742 - protein, 765 aa, Homo sapiens
  ENSP00000460215
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTGTVAVR

SEQ ID NO: 37743 - protein, 775 aa, Homo sapiens
  ENSP00000483947
MSHHTWPSPALNLDFATYLLRDLGAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTADFNKIQDSSRNNSKTTLNAFEEVEEFPETSV

SEQ ID NO: 37744 - protein, 765 aa, Homo sapiens
  ENSP00000352358
TGPLQGDGGPALGGADVAPRLSPVRVWPRPQAPKEPALHPMGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHTRGSEDLDKDSVEKLELGCPFSPHLSLPMPSVSRSTSRSSANWERLRQGTLRRDLRGIINRGLEDGESWEYQI

SEQ ID NO: 37745 - protein, 122 aa, Homo sapiens
  ENSP00000411100
MTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAV

SEQ ID NO: 37746 - protein, 56 aa, Homo sapiens
  ENSP00000415917
MPGAMGETALHIAALYDNLEAAMVLMEAAPELVFEPMTSELYEGQTALHIAVVNQN

SEQ ID NO: 37747 - protein, 765 aa, Homo sapiens
  ENSP00000492723
MGPLQGDGGPALGGADVAPRLSPVRVWPRPQAPKEPALHPMGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHTRGSEDLDKDSVEKLELGCPFSPHLSLPMPSVSRSTSRSSANWERLRQGTLRRDLRGIINRGLEDGESWEYQI

SEQ ID NO: 37748 - protein, 725 aa, Homo sapiens
  ENSP00000479828
MGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPRNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYVTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQVVATTVMLERKLPRCLWPRSGICGREYGLGDRWFLRVEDRQDLNRQRIQRYAQAFHTRGSEDLDKDSVEKLELGCPFSPHLSLPTPSVSRSTSRSSANWERLRQGTLRRDLRGIINRGLEDGESWEYQI

SEQ ID NO: 37749 - protein, 90 aa, Homo sapiens
  ENSP00000488490
MGVTRFFGQTILGGPFHVLIITYAFMVLVTMVMRLISASGEVVPMSFALVLGWCNVMYFARGFQMLGPFTIMIQKMIFGDLMRFCWLMAV

SEQ ID NO: 37750 - protein, 20 aa, Homo sapiens
  ENSP00000487762
  MOD_RES (1)..(1): Any amino acid
XALNKLLKYEDCKVHQREAI

SEQ ID NO: 37751 - protein, 780 aa, Homo sapiens
  ENSP00000354543
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRNPSTAFYQAFHLNTLKESKSLWDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 37752 - protein, 116 aa, Homo sapiens
  ENSP00000418149
  MOD_RES (1)..(1): Any amino acid
XLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRIW

SEQ ID NO: 37753 - protein, 204 aa, Homo sapiens
  ENSP00000417747
  MOD_RES (1)..(1): Any amino acid
XIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 37754 - protein, 81 aa, Homo sapiens
  ENSP00000420689
  MOD_RES (1)..(1): Any amino acid
XENKPVVKPPVADSLANPLQLTPMNSLATSVFSIAIPVDGDEDRNPSTAFYQAFHLNTLKESKSLWDRIFFRIQHRRRNVT

SEQ ID NO: 37755 - protein, 77 aa, Homo sapiens
  ENSP00000361466
MDLVKNHLMYAVREEVEILKEQIRELVEKNSQLERENTLLKTLASPEQLEKFQSCLSPEEPAPESPQVPEAPGGSAV

SEQ ID NO: 37756 - protein, 134 aa, Homo sapiens
  ENSP00000361474
MNTEMYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 37757 - protein, 200 aa, Homo sapiens
  ENSP00000314655
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 37758 - protein, 200 aa, Homo sapiens; identical to SEQ ID NO: 37757
  ENSP00000361458

SEQ ID NO: 37759 - protein, 200 aa, Homo sapiens; identical to SEQ ID NO: 37757
  ENSP00000361459

SEQ ID NO: 37760 - protein, 110 aa, Homo sapiens
  ENSP00000361457
MAFQPPYSSSLFRKRDNASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 37761 - protein, 200 aa, Homo sapiens; identical to SEQ ID NO: 37757
  ENSP00000427427

SEQ ID NO: 37762 - protein, 132 aa, Homo sapiens
  ENSP00000421016
MRQDSLEPVLRDPCYLINEGICNRNIDQTMLSILLFFHSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 37763 - protein, 25 aa, Homo sapiens
  ENSP00000425414
MDLVKNHLMYAVREEVEILKEQIRE

SEQ ID NO: 37764 - protein, 100 aa, Homo sapiens
  ENSP00000422060
MNTEMYQTPMEVAVYQLHNFSISFFSSLLGGDVVSVKLDNSASGASVVAIDNKIEQAMVSGITASFSSPDLAAAYVTLGRIEGMGEKALSQNPEEADSLP

SEQ ID NO: 37765 - protein, 124 aa, Homo sapiens
  ENSP00000427199
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQAM

SEQ ID NO: 37766 - protein, 122 aa, Homo sapiens
  ENSP00000425155
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNKIEQ

SEQ ID NO: 37767 - protein, 119 aa, Homo sapiens
  ENSP00000422636
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAIDNK

SEQ ID NO: 37768 - protein, 116 aa, Homo sapiens
  ENSP00000424653
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLSILLFFHSASGASVVAI

SEQ ID NO: 37769 - protein, 100 aa, Homo sapiens
  ENSP00000427075
MAQSKLDCRSPVGLDCCNCCLDLAHRSGLQRGSSGENNNPGSPTVSNFRQLQEKLVFENLNTDKLNSIMRQDSLEPVLRDPCYLINEGICNRNIDQTMLS

SEQ ID NO: 37770 - protein, 84 aa, Homo sapiens
  ENSP00000425158
MAQSKLDCRSPVGLDCCNCCLDLAHRSGLQRGSSGENNNPGSPTVSNFRQLQEKLVFENLNTDKLNSIMRQDSLEPVLRDPCYL

SEQ ID NO: 37771 - protein, 58 aa, Homo sapiens
  ENSP00000422228
MAQSKLDCRSPVGLDCCNCCLDLAHRSGLQRGSSGENNNPGSPTVSNFRQLQEKLVFE

SEQ ID NO: 37772 - protein, 138 aa, Homo sapiens
  ENSP00000358530
MTALFLMSMLFGLTCGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 37773 - protein, 138 aa, Homo sapiens; identical to SEQ ID NO: 37772
  ENSP00000256592

SEQ ID NO: 37774 - protein, 1034 aa, Homo sapiens
  ENSP00000360552
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 37775 - protein, 1031 aa, Homo sapiens
  ENSP00000475114
MMAAALLHYTGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 37776 - protein, 194 aa, Homo sapiens
  ENSP00000474159
RKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 37777 - protein, 74 aa, Homo sapiens
  ENSP00000487408
MKFQECHSEVMRHGQKIYPSHHRIEMAVEIASLKCQHSSINQSPTRKNSNSTTGWLLWDLLMGIGNSGSNVVLT

SEQ ID NO: 37778 - protein, 1031 aa, Homo sapiens; identical to SEQ ID NO: 37775
  ENSP00000333114

SEQ ID NO: 37779 - protein, 41 aa, Homo sapiens
  ENSP00000443890
MAHYKTEQDDWLIIYLKYLLFVFNFFFWVSEFCTHILFPEH

SEQ ID NO: 37780 - protein, 253 aa, Homo sapiens
  ENSP00000437403
MAHYKTEQDDWLIIYLKYLLFVFNFFFWVGGAAVLAVGIWTLVEKSGYLSVLASSTFAASAYILIFAGVLVMVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 37781 - protein, 182 aa, Homo sapiens
  ENSP00000445503
MVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 37782 - protein, 253 aa, Homo sapiens; identical to SEQ ID NO: 37780
  ENSP00000261177

SEQ ID NO: 37783 - protein, 270 aa, Homo sapiens
  ENSP00000396270
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 37784 - protein, 147 aa, Homo sapiens
  ENSP00000418195
MHYYRYSNAKVSCWYKYLLFSYNIIFWNQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 37785 - protein, 223 aa, Homo sapiens
  ENSP00000361230
MERKVLPCFLCLFQGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFL

SEQ ID NO: 37786 - protein, 253 aa, Homo sapiens
  ENSP00000361237
MHYYRYSNAKVSCWYKYLLFSYNIIFWGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 37787 - protein, 270 aa, Homo sapiens; identical to SEQ ID NO: 37783
  ENSP00000361231

SEQ ID NO: 37788 - protein, 213 aa, Homo sapiens
  ENSP00000344076
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFNQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 37789 - protein, 270 aa, Homo sapiens; identical to SEQ ID NO: 37783
  ENSP00000361229

SEQ ID NO: 37790 - protein, 253 aa, Homo sapiens; identical to SEQ ID NO: 37786
  ENSP00000480263

SEQ ID NO: 37791 - protein, 294 aa, Homo sapiens
  ENSP00000362387
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 37792 - protein, 160 aa, Homo sapiens
  ENSP00000404528
LQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQITGVSD

SEQ ID NO: 37793 - protein, 146 aa, Homo sapiens
  ENSP00000433592
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITVS

SEQ ID NO: 37794 - protein, 79 aa, Homo sapiens
  ENSP00000434625
MEGDCLSCMKYLMFVFNFFIFLGGACLLAIGIWVMVDPTGFREIVAANPLLLTGAYILLAMGGLLFLLGFLGCCGAVRE

SEQ ID NO: 37795 - protein, 138 aa, Homo sapiens
  ENSP00000433362
MEGDCLSCMKYLMFVFNFFIFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLN

SEQ ID NO: 37796 - protein, 248 aa, Homo sapiens
  ENSP00000429993
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 37797 - protein, 157 aa, Homo sapiens
  ENSP00000427942
MPEELPRWSTMEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITVSD

SEQ ID NO: 37798 - protein, 76 aa, Homo sapiens
  ENSP00000430343
MPEELPRWSTMEGDCLSCMKYLMFVFNFFIFLGGACLLAIGIWVMVDPTGFREIVAANPLLLTGAYILLAMGGLLF

SEQ ID NO: 37799 - protein, 271 aa, Homo sapiens
  ENSP00000429020
  MOD_RES (1)..(1): Any amino acid
XWSTMEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIEEERAHSVSQATGILYQLPASPQAFQSPGTLGATA

SEQ ID NO: 37800 - protein, 248 aa, Homo sapiens; identical to SEQ ID NO: 37796
  ENSP00000339820

SEQ ID NO: 37801 - protein, 221 aa, Homo sapiens
  ENSP00000358529
MGRFRGGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 37802 - protein, 196 aa, Homo sapiens
  ENSP00000358528
MGRFRGGLRCIKYLLLGFNLLFWLAGSAVIAFGLWFRFGGAIKELSSEDKSPEYFYVGLYVLVGAGALMMAVGFFGCCGAMRESQCVLGSAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 37803 - protein, 187 aa, Homo sapiens
  ENSP00000415256
GLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKIFGMIFSMVLCCAIRNSRDVI

SEQ ID NO: 37804 - protein, 193 aa, Homo sapiens
  ENSP00000421808
MSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYIPMQVESDVAFHSPAALKIPQKMSSTLSVAMMPGKNQKLTSRL

SEQ ID NO: 37805 - protein, 268 aa, Homo sapiens
  ENSP00000307701
MSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 37806 - protein, 197 aa, Homo sapiens
  ENSP00000423916
MFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 37807 - protein, 87 aa, Homo sapiens
  ENSP00000422351
  MOD_RES (1)..(1): Any amino acid
XVSCCIKYFIFGFNVIFWFLGITFLGIGLWAWNEKGVLSNISSITDLGGFDPVWLFLVVGGVMFILGFAGCIGALRENTFLLKFDKQ

SEQ ID NO: 37808 - protein, 110 aa, Homo sapiens
  ENSP00000423504
MFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCG

SEQ ID NO: 37809 - protein, 60 aa, Homo sapiens
  ENSP00000426248
MFILGFAGCIGALRENTFLLKFFSVFLGIIFFLELTAGVLAFVFKDWIKDQLYFFINNNI

SEQ ID NO: 37810 - protein, 38 aa, Homo sapiens
  ENSP00000422548
MFILGFAGCIGALRENTFLLKFLKSPVLTEQAENYTFL

SEQ ID NO: 37811 - protein, 245 aa, Homo sapiens
  ENSP00000362111
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 37812 - protein, 129 aa, Homo sapiens
  ENSP00000482130
MLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNELIGIFLAYCLSRAITNNQYEIV

SEQ ID NO: 37813 - protein, 137 aa, Homo sapiens
  ENSP00000482894
MLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQDI

SEQ ID NO: 37814 - protein, 171 aa, Homo sapiens
  ENSP00000462518
RRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQDWGCTTQGSPGPPGGPCTPSSGSAPRIERGEPQGRSEKVWGFFSKGKQLLRRLGSGKKE

SEQ ID NO: 37815 - protein, 1797 aa, Homo sapiens
  ENSP00000268893
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 37816 - protein, 1857 aa, Homo sapiens
  ENSP00000345824
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVVSAPLPRPGTSLELCRKALARQRARDLSETASALLAKDKQIAALQRECRELQARLTLVGKEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 37817 - protein, 270 aa, Homo sapiens
  ENSP00000462822
  MOD_RES (1)..(1): Any amino acid
XAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQ

SEQ ID NO: 37818 - protein, 296 aa, Homo sapiens
  ENSP00000462710
  MOD_RES (1)..(1): Any amino acid
XAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSAHTTGPPPKPRRSKK

SEQ ID NO: 37819 - protein, 516 aa, Homo sapiens
  ENSP00000342499
MPSSTSPDQGDDLENCILRFSDLDLKDMSLINPSSSLKAELDGSTKKKYSFAKKKAFALFVKTKEVPTKRSFECKEKLWKCCRQLFTDQTSIHRHVATQHADEIYHQTASILKQLAVTLSTSKSLSSADEKNPLKECLPHSHDVSAWLPDISCFNPDELISGQGSEEGEVLLYYCYHDLEDPQWICAWQTALCQHLHLTGKIRIAAEGINGTVGGSKLATRLYVEVMLSFPLFKDDLCKDDFKTSKGGAHCFPELRVGVFEEIVPMGISPKKISYKKPGIHLSPGEFHKEVEKFLSQANQEQSDTILLDCRNFYESKIGRFQGCLAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 37820 - protein, 59 aa, Homo sapiens
  ENSP00000364315
MPSSTSPDQGDDLENCILRFSDLDLKDMSLINPSSSLKAELDGSTKKKYSFAKKKVEFL

SEQ ID NO: 37821 - protein, 7 aa, Homo sapiens
  ENSP00000364308
  MOD_RES (1)..(1): Any amino acid
XKKVEFL

SEQ ID NO: 37822 - protein, 361 aa, Homo sapiens
  ENSP00000422188
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQDK

SEQ ID NO: 37823 - protein, 49 aa, Homo sapiens
  ENSP00000424418
MQASPIRIPTVSNDIDWDFCFHMPPSSGQETCYISQEYTVDLEGKYDLK

SEQ ID NO: 37824 - protein, 287 aa, Homo sapiens
  ENSP00000425242
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQMLLRYIS

SEQ ID NO: 37825 - protein, 287 aa, Homo sapiens; identical to SEQ ID NO: 37824
  ENSP00000484792

SEQ ID NO: 37826 - protein, 359 aa, Homo sapiens
  ENSP00000491000
MQASPIRIPTVSNDIDWDFCFHMSQQTEIPAHQQTDELYPTGGCGESEEETKAKEKEKAIDCMSHPKEKLAQSQKKVAQLIKEKMNTQANKELIRCVILSRIIFGDHHWKCARALANLAYGYLTLRGLPVQAKKHATSAKNTLLTWKANTTSNKEKEEILEALVKLYYTLGVAWLLQNRGREAYFNLQKAERNMKELKELYKGGVCELQVSENDLTLALGRASLAIHRLNLALAYFEKAIGDVIAAKGDRTSDLISLYEEAAQIEQLRRNHNQAIQYLQQAHSVCVSLFTEVSPKTAEMSALLAKAYAMSGEAQHRDAVEIYFIRSINAYRATLGSEDFETLSTTEEFCKWLVQNGEKQ

SEQ ID NO: 37827 - protein, 2481 aa, Homo sapiens
  ENSP00000381003
MEQSPPPAPEPTQGPTPARSRRRREPESPPASAPIPLFGADTIGQRSPDGPVLSKAEFVEKVRQSNQACHDGDFHTAIVLYNEALAVDPQNCILYSNRSAAYMKIQQYDKALDDAIKARLLNPKWPKAYFRQGVALQYLGRHADALAAFASGLAQDPKSLQLLVGMVEAAMKSPMRDSLEPTYQQLQKMKLDKSPFVVVSVVGQELLTAGHHGASVVVLEAALKIGTCSLKLRGSVFSALSSAYWSLGNTEKSTGYMQQDLDVAKTLGDQTGECRAHGNLGSAFFSKGNYREALTNHRHQLVLAMKLKDREAASSALSSLGHVYTAIGDYPNALASHKQCVLLAKQSKDELSEARELGNMGAVYIAMGDFENAVQCHEQHLKIAKDLGNKREEARAYSNLGSAYHYRRNFDKAMSYHNYVLELAQELMEKAIEMRAYAGLGHAARCMQDLERAKQYHEQQLGIAEDLKDRAAEGRASSNLGIIHQMKGDYDTALKLHKTHLCIAQELSDYAAQGRAYGNMGNAYNALGMYDQAVKYHRQELQISMEVNDRASQASTHGNLAVAYQALGAHDRALQHYQNHLNIARELRDIQSEARALSNLGNFHCSRGEYVQAAPYYEQYLRLAPDLQDMEGEGKVCHNLGYAHYCLGNYQEAVKYYEQDLALAKDLHDKLSQAKAYCNLGLAFKALLNFSKAEECQKYLLSLAQSLNNSQAKFRALGNLGDIFICKKDINGAIKFYEQQLGLAHQVKDRRLEASAYAALGTAYRMIQKYDKALGYHTQELEVYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRSCQSMTSLFSNTVSPTQDGTSSLPRRQSSFAKPPLRALYDLLIAPMEGGLMHSSGPVGRHRQLILVLEGELYLIPFALLKGSSSNEYLYERFGLLAVPSIRSLSVQSKSHLRKNPPTYSSSTSMAAVIGNPKLPSAVMDRWLWGPMPSAEEEAYMVSELLGCQPLVGSVATKERVMSALTQAECVHFATHISWKLSALVLTPSMDGNPASSKSSFGHPYTIPESLRVQDDASDGESISDCPPLQELLLTAADVLDLQLPVKLVVLGSSQESNSKVTADGVIALTRAFLAAGAQCVLVSLWPVPVAASKMFIHAFYSSLLNGLKASAALGEAMKVVQSSKAFSHPSNWAGFMLIGSDVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRAVKNMVGMLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 37828 - protein, 301 aa, Homo sapiens
  ENSP00000410244
DVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQD

SEQ ID NO: 37829 - protein, 108 aa, Homo sapiens
  ENSP00000388788
EQHIASVREALGVESHYSRACASSETESEAGDIMDQQFEEMNNKLNSVTDPTGFLRMVRRNNLFNRDATRFAEAWDWAWTHVLALPTSQPVKAGDTYLHQVMQAVVIN

SEQ ID NO: 37830 - protein, 2354 aa, Homo sapiens
  ENSP00000479834
AYFRQGVALQYLGRHADALAAFASGLAQDPKSLQLLVGMVEAAMKSPMRDSLEPTYQQLQKMKLDKSPFVVVSVVGQELLTAGHHGASVVVLEAALKIGTCSLKLRGSVFSALSSAYWSLGNTEKSTGYMQQDLDVAKTLGDQTGECRAHGNLGSAFFSKGNYREALTNHRHQLVLAMKLKDREAASSALSSLGHVYTAIGDYPNALASHKQCVLLAKQSKDELSEARELGNMGAVYIAMGDFENAVQCHEQHLKIAKDLGNKREEARAYSNLGSAYHYRRNFDKAMSYHNYVLELAQELMEKAIEMRAYAGLGHAARCMQDLERAKQYHEQQLGIAEDLKDRAAEGRASSNLGIIHQMKGDYDTALKLHKTHLCIAQELSDYAAQGRAYGNMGNAYNALGMYDQAVKYHRQELQISMEVNDRASQASTHGNLAVAYQALGAHDRALQHYQNHLNIARELRDIQSEARALSNLGNFHCSRGEYVQAAPYYEQYLRLAPDLQDMEGEGKVCHNLGYAHYCLGNYQEAVKYYEQDLALAKDLHDKLSQAKAYCNLGLAFKALLNFSKAEECQKYLLSLAQSLNNSQAKFRALGNLGDIFICKKDINGAIKFYEQQLGLAHQVKDRRLEASAYAALGTAYRMIQKYDKALGYHTQELEVYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRSCQSMTSLFSNTVSPTQDGTSSLPRRQSSFAKPPLRALYDLLIAPMEGGLMHSSGPVGRHRQLILVLEGELYLIPFALLKGSSSNEYLYERFGLLAVPSIRSLSVQSKSHLRKNPPTYSSSTSMAAVIGNPKLPSAVMDRWLWGPMPSAEEEAYMVSELLGCQPLVGSVATKERVMSALTQAECVHFATHISWKLSALVLTPSMDGNPASSKSSFGHPYTIPESLRVQDDASDGESISDCPPLQELLLTAADVLDLQLPVKLVVLGSSQESNSKVTADGVIALTRAFLAAGAQCVLVSLWPVPVAASKMFIHAFYSSLLNGLKASAALGEAMKVVQSSKAFSHPSNWAGFMLIGSDVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRAVKNMVGMLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 37831 - protein, 52 aa, Homo sapiens
  ENSP00000385708
MEGQRQESHATLTLAQAHFNNGEYAEAEALYSAYIRRCACAASSDESPGRIF

SEQ ID NO: 37832 - protein, 151 aa, Homo sapiens
  ENSP00000333018
MEGQRQESHATLTLAQAHFNNGEYAEAEALYSAYIRRCACAASSDESPGSKCSPEDLATAYNNRGQIKYFRVDFYEAMDDYTSAIEVQPNFEVPYYNRGLILYRLGYFDDALEDFKKVLDLNPGFQDATLSLKQTILDKEEKQRRNVAKNY

SEQ ID NO: 37833 - protein, 86 aa, Homo sapiens
  ENSP00000412874
MDVSEGTTMSSSHSYLISSRQCWNHSDRLISKCSPEDLATAYNNRGQIKYFRVDFYEAMDDYTSAIEVQPNFEVPYYNRGLILYRL

SEQ ID NO: 37834 - protein, 112 aa, Homo sapiens
  ENSP00000399930
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNE

SEQ ID NO: 37835 - protein, 140 aa, Homo sapiens
  ENSP00000399782
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYA

SEQ ID NO: 37836 - protein, 109 aa, Homo sapiens
  ENSP00000401686
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLC

SEQ ID NO: 37837 - protein, 151 aa, Homo sapiens
  ENSP00000414965
MNRLRNAKIYVERAVKKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTKVGLC

SEQ ID NO: 37838 - protein, 160 aa, Homo sapiens
  ENSP00000408128
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVK

SEQ ID NO: 37839 - protein, 115 aa, Homo sapiens
  ENSP00000394481
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPY

SEQ ID NO: 37840 - protein, 122 aa, Homo sapiens
  ENSP00000400462
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRR

SEQ ID NO: 37841 - protein, 148 aa, Homo sapiens
  ENSP00000402197
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTK

SEQ ID NO: 37842 - protein, 203 aa, Homo sapiens
  ENSP00000395912
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTKVGLCLNLRNLPWFDEVDANSFFPRCYCLGAEDDKKAFIETGFHCVSQDGLDLLTS

SEQ ID NO: 37843 - protein, 915 aa, Homo sapiens
  ENSP00000392549
MQGPDAPLLLSARELGPGRRGSASWYRQEGGAVCNWLRKPQPLEPRTSFPSARRSEFRPPRRLPWAGPASAQSEEGHAGGRCQAGSPAPARRLSGAFKTLVPGTHAQGASDTHPLGPPHTPVLDPSPQDGFPVLWRGSSKASHMNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKAPALLCLRGPQLEVPCCLCPLKSEQFLAPVGRSRPKANSRPDCDKPRAEACPMKRLSPLKPLPLVGTFQRRRGLGDMKLGKPLLRFPTALVLDPTPNKKKQVKYLGLDSIAVGGSRVDGARPCTPGSTARA

SEQ ID NO: 37844 - protein, 189 aa, Homo sapiens
  ENSP00000389904
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMSRMVQNEIPYFIWTTRRDVLDCRFLSKDQMINHYARAGSFTTKVGLCLNLRNLPWFDEVDANSFFPRCYCLGAEDDKKAFIGKE

SEQ ID NO: 37845 - protein, 116 aa, Homo sapiens
  ENSP00000398996
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMASCAWTTWRRC

SEQ ID NO: 37846 - protein, 161 aa, Homo sapiens
  ENSP00000412915
MNRLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMVDANSFFPRCYCLGAEDDKKAFIEDFWLTAARNVLKLVVKSEWKSYPIQAVEEEAS

SEQ ID NO: 37847 - protein, 118 aa, Homo sapiens
  ENSP00000396606
  MOD_RES (1)..(1): Any amino acid
XLRNAKIYVERAVKQKKIFTIQGCYPVIRCLLRRRGWVEKKMVHRSGPTLLPPQKDLDSSAMGDSDTTEDEDEDEDEEFQPSQLFDFDDLLKFDDLDGTHALMRRGRTQAPRHSGPAL

SEQ ID NO: 37848 - protein, 520 aa, Homo sapiens
  ENSP00000312148
  MOD_RES (1)..(1): Any amino acid
XFDDLLKFDDLDGTHALMSRMVQNEIPYFIWTTRRDVLDCRFLSKDQMINHYARAGSFTTKVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 37849 - protein, 27 aa, Homo sapiens
  ENSP00000473440
LKFDDLDGTHALMRRGFTVLARMVSIS

SEQ ID NO: 37850 - protein, 70 aa, Homo sapiens
  ENSP00000473376
  MOD_RES (1)..(1): Any amino acid
XKFDDLDGTHALMSRMVQNEIPYFIWTTRRDVLDCRFLSKDQMINHYARAGSFTTKRRGFTVLARMVSIS

SEQ ID NO: 37851 - protein, 193 aa, Homo sapiens
  ENSP00000399191
  MOD_RES (1)..(1): Any amino acid
XKFDDLDGTHALMSRMVQNEIPYFIWTTRRDVLDCRFLSKDQMINHYARAGSFTTKVGLCLNLRNLPWFDEVDANSFFPRCYCLGAEDDKKAFIGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEG

SEQ ID NO: 37852 - protein, 619 aa, Homo sapiens
  ENSP00000398097
SRMVQNEIPYFIWTTRRDVLDCRFLSKDQMINHYARAGSFTTKVGLCLNLRNLPWFDEVDANSFFPRCYCLGAEDDKKAFIEDFWLTAARNVLKLVVKSEWKSYPIQAVEEEASGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEGKDSGTPTHSRGIRKFKEVAQGCTAQKGHSWDADPARHHFPSLHTKAQLPSPHVLRHQGQVLRRQHSKLVGTKALSTTGKALRTLPTAKVFISLPPNLDFKVAPSILKPRKVGLDL

SEQ ID NO: 37853 - protein, 352 aa, Homo sapiens
  ENSP00000373338
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 37854 - protein, 108 aa, Homo sapiens
  ENSP00000430051
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGNPSP

SEQ ID NO: 37855 - protein, 326 aa, Homo sapiens
  ENSP00000409632
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQGPAPNMQVSPERNAPLCPAP

SEQ ID NO: 37856 - protein, 352 aa, Homo sapiens; identical to SEQ ID NO: 37853
  ENSP00000409246

SEQ ID NO: 37857 - protein, 434 aa, Homo sapiens
  ENSP00000403874
MDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPAVEVPQYVGIRLLVEGFTIKKPMAMCHRRMGVRPAVPLLTQRGSGEARHHFPSLHTKAQLPSPHVLRHQGQVLRRQHSKLVGTKALSTTGKALRTLPTAKVFISLPPNLDFKVAPSILKPRKVGLDL

SEQ ID NO: 37858 - protein, 181 aa, Homo sapiens
  ENSP00000473314
  MOD_RES (1)..(1): Any amino acid
XTVQCRKASFELYGADFVFGEDFQPWLIEINASPTMAPSTAVTARLCAGVQADTLRVVIDRMLDRNCDTGAFELIYKQAPALLCLRGPQLEVPCCLCPLKSEQFLAPVGRSRPKANSRPDCDKPRAEACPMKRLSPLKPLPLVGTFQRRRGLGDMKLGKPLLRFPTALVLDPTPNKKKQVK

SEQ ID NO: 37859 - protein, 1281 aa, Homo sapiens
  ENSP00000450713
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRPVSAQFQSSKAKQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 37860 - protein, 269 aa, Homo sapiens
  ENSP00000286650
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARKCNWKMGNTMDKRRLPIYVQVL

SEQ ID NO: 37861 - protein, 1281 aa, Homo sapiens
  ENSP00000298832
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPRSYELTRKDRLYKNIIRMQHTHGFKAFHILPQTFLLPAEYAEFCNSYSKDRGPWIVKPVASSRGRGVYLINNPNQISLEENILVSRYINNPLLIDDFKFDVRLYVLVTSYDPLVIYLYEEGLARFATVRYDQGAKNIRNQFMHLTNYSVNKKSGDYVSCDDPEVEDYGNKWSMSAMLRYLKQEGRDTTALMAHVEDLIIKTIISAELAIATACKTFVPHRSSCFELYGFDVLIDSTLKPWLLEVNLSPSLACDAPLDLKIKASMISDMFTVVGFVCQDPAQRASTRPIYPTFESSRRNPFQKPQRCRPLSASDAEMKNLVGSAREKGPGKLGGSVLGLSMEEIKVLRRVKEENDRRGGFIRIFPTSETWEIYGSYLEHKTSMNYMLATRLFQDRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASKGSSAEGQLNGLQSSLNPAAFVPITSSTDPAHTKI

SEQ ID NO: 37862 - protein, 817 aa, Homo sapiens
  ENSP00000452524
MEEIKVLRRVKEENDRRGGFIRIFPTSETWEIYGSYLEHKTSMNYMLATRLFQDRGNPRRSLLTGRTRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 37863 - protein, 775 aa, Homo sapiens
  ENSP00000451946
MNYMLATRLFQDRGNPRRSLLTGRTRMTADGAPELKIESLNSKAKLHAALYERKLLSLEVRKRRRRSSRLRAMRPKYPVITQPAEMNVKTETESEEEEEVALDNEDEEQEASQEESAGFLRENQAKYTPSLTALVENTPKENSMKVREWNNKGGHCCKLETQELEPKFNLMQILQDNGNLSKMQARIAFSAYLQHVQIRLMKDSGGQTFSASWAAKEDEQMELVVRFLKRASNNLQHSLRMVLPSRRLALLERRRILAHQLGDFIIVYNKETEQMAEKKSKKKVEEEEEDGVNMENFQEFIRQASEAELEEVLTFYTQKNKSASVFLGTHSKISKNNNNYSDSGAKGDHPETIMEEVKIKPPKQQQTTEIHSDKLSRFTTSAEKEAKLVYSNSSSGPTATLQKIPNTHLSSVTTSDLSPGPCHHSSLSQIPSAIPSMPHQPTILLNTVSASASPCLHPGAQNIPSPTGLPRCRSGSHTIGPFSSFQSAAHIYSQKLSRPSSAKAGSCYLNKHHSGIAKTQKEGEDASLYSKRYNQSMVTAELQRLAEKQAARQYSPSSHINLLTQQVTNLNLATGIINRSSASAPPTLRPIISPSGPTWSTQSDPQAPENHSSSPGSRSLQTGGFAWEGEVENNVYSQATGVVPQHKYHPTAGSYQLQFALQQLEQQKLQSRQLLDQSRARHQAIFGSQTLPNSNLWTMNNGAGCRISSATASGQKPTTLPQKVVPPPSSCASLVPKPPPNHEQVLRRATSQKASNTRFRSSFQNYLWYFFQAVS

SEQ ID NO: 37864 - protein, 60 aa, Homo sapiens
  ENSP00000478640
NLLTQQVTNLNLATGIINRSSASAPPTLRPIISPSGPTWSTQSDPQAPENHSSSPGSSFI

SEQ ID NO: 37865 - protein, 124 aa, Homo sapiens
  ENSP00000451917
MPIVMARDLEETASSSEDEEVISQEDHPCIMWTGGCRRIPVLVFHADAILTKDNNIRVIGERYHLSYKIVRTDSRLVRSILTAHGFHEVHPSSTDYNLMWTGSHLKPFLLRTLSEAQKVNHFPR

SEQ ID NO: 37866 - protein, 278 aa, Homo sapiens
  ENSP00000260116
MAEARSQPSAGPQLNALPDHSPLLQPGLAALRRRAREAGVPLAPLPLTDSFLLRFLRARDFDLDLAWRLLKNYYKWRAECPEISADLHPRSIIGLLKAGYHGVLRSRDPTGSKVLIYRIAHWDPKVFTAYDVFRVSLITSELIVQEVETQRNGIKAIFDLEGWQFSHAFQITPSVAKKIAAVLTDSFPLKVRGIHLINEPVIFHAVFSMIKPFLTEKIKERIHMHGNNYKQSLLQHFPDILPLEYGGEEFSMEDICQEWTNFIMKSEDYLSSISESIQ

SEQ ID NO: 37867 - protein, 523 aa, Homo sapiens
  ENSP00000258796
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 37868 - protein, 491 aa, Homo sapiens
  ENSP00000385316
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 37869 - protein, 116 aa, Homo sapiens
  ENSP00000383227
MGPLPCSPLRNTFMVSKRGFSPPQAPNFPTRPENLRTTAGVGDPARTQALLLLGAAALACLALDLLFLLFYSFWLCCRRRKSEEHLDADCCCTAWCVIIATLVCSAGIAVGFYGNG

SEQ ID NO: 37870 - protein, 352 aa, Homo sapiens
  ENSP00000385015
MPSGVPGCWPQLPLKGPWRPTPRPRVPVPWRTPRFACRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 37871 - protein, 186 aa, Homo sapiens
  ENSP00000413757
DPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSRYLAALDSGSHAGWQFKPMDSARTLW

SEQ ID NO: 37872 - protein, 47 aa, Homo sapiens
  ENSP00000407624
MIDLEPTVVDEVRAGTYRQLFHPEQLITGKEDAANNYARGHYTVGKE

SEQ ID NO: 37873 - protein, 383 aa, Homo sapiens
  ENSP00000318575
MIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 37874 - protein, 449 aa, Homo sapiens
  ENSP00000333326
MRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 37875 - protein, 467 aa, Homo sapiens
  ENSP00000412646
MLWGCRAKACWGPRLSDLVASLSPQRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEE

SEQ ID NO: 37876 - protein, 275 aa, Homo sapiens
  ENSP00000477306
  MOD_RES (1)..(1): Any amino acid
XFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHCQRIQLGISCSSMTSLVSASLEPFLKAVFDFHESFEDGRPADLQNAPRFGLARTRVLAKGFRLLTFDGNSTEVIPRWLHSVLWWHAIPVFPALMTFLYRIFTLITFFIVIM

SEQ ID NO: 37877 - protein, 445 aa, Homo sapiens [sequence omitted]

SEQ ID NO: 37878 - protein, 444 aa, Homo sapiens
  ENSP00000264071
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 37879 - protein, 155 aa, Homo sapiens
  ENSP00000472481
MREIVHLQAGQCGNQIGAKFWEVISDEHGIDPTGTYHGDSDLQLERINVYYNEEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVP

SEQ ID NO: 37880 - protein, 160 aa, Homo sapiens
  ENSP00000469936
MREIVHLQAGQCGNQIGAKFWEVISDEHGIDPTGTYHGDSDLQLERINVYYNEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVS

SEQ ID NO: 37881 - protein, 144 aa, Homo sapiens
  ENSP00000470983
MREIVHLQAGQCGNQIGAKFWEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVS

SEQ ID NO: 37882 - protein, 109 aa, Homo sapiens
  ENSP00000469560
MREIVHLQAGQCGNQIGAKFWEVISDEHGIDPTGTYHGDSDLQLERINVYYNEATGGNYVPRAVLVDLEPGTMDSVRSGPFGQIFRPDNFVFGESPSREPEAGKPPYSC

SEQ ID NO: 37883 - protein, 93 aa, Homo sapiens
  ENSP00000471320
MREIVHLQAHTMGTVTCNWRGSTCTTTRPQEEIMSPERCWWTWNPAPWTLSVLAPSVRSFGRTTSCLANPEPATTGQRGTTRRAQSWWTLSWT

SEQ ID NO: 37884 - protein, 104 aa, Homo sapiens
  ENSP00000472795
MREIVHLQAGQCGNQIGAKAHTMGTVTCNWRGSTCTTTRPQEEIMSPERCWWTWNPAPWTLSVLAPSVRSFGRTTSCLANPEPATTGQRGTTRRAQSWWTLSWT

SEQ ID NO: 37885 - protein, 74 aa, Homo sapiens
  ENSP00000471880
MDSVRSGPFGQIFRPDNFVFGQSGAGNNWAKGHYTEGAELVDAVLDVVRKEAESCDCLQGFQLTHSLGGGTGSG

SEQ ID NO: 37886 - protein, 167 aa, Homo sapiens
  ENSP00000472375
MRRGAADRETEGPCSAVSAASSTLAAAAAPRARATAAASTLSATAMREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRK

SEQ ID NO: 37887 - protein, 110 aa, Homo sapiens
  ENSP00000468843
MREIVHLQAGQCGNQIGAKFWEVISDEHGIDPTGTYHGDSDLQLERINVYYNEATGGNYVPRAVLVDLEPGTMDSVRSGPFGQIFRPDNFVFVETGFHRVSQDGLDLLTS

SEQ ID NO: 37888 - protein, 103 aa, Homo sapiens
  ENSP00000471503
MREIVHLQAGQCGNQIGAKFWEVISDEHGIDPTGTYHGDSDLQLERINVYYNEATGGNYVPRAVLVDLEPGTMDSVRSGPFGQIFRPDNFVFDRVCLSCCHPG

SEQ ID NO: 37889 - protein, 107 aa, Homo sapiens
  ENSP00000469660
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYT

SEQ ID NO: 37890 - protein, 157 aa, Homo sapiens
  ENSP00000470627
MRRGAADRETERLPGAQGPCSAVSAASSTLAAAAAPRARATAAASTLSATAMREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHY

SEQ ID NO: 37891 - protein, 170 aa, Homo sapiens
  ENSP00000444110
MMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTFSSFCQKTEDTGYRHFRFCYCRPTS

SEQ ID NO: 37892 - protein, 137 aa, Homo sapiens
  ENSP00000442631
MGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVA

SEQ ID NO: 37893 - protein, 39 aa, Homo sapiens
  ENSP00000437899
MEASRCRLSPSGDSVFHEEMMKMRQAKLDYQVLMVQLLS

SEQ ID NO: 37894 - protein, 39 aa, Homo sapiens; identical to SEQ ID NO: 37893
  ENSP00000441599

SEQ ID NO: 37895 - protein, 442 aa, Homo sapiens
  ENSP00000410051
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDSKLACE

SEQ ID NO: 37896 - protein, 501 aa, Homo sapiens
  ENSP00000380321
MEASRCRLSPSGDSVFHEEMMKMRQAKLDYQRLLLEKRQRKKRLEPFMVQPNPEARLRRAKPRASDEQTPLVNCHTPHSNVILHGIDGPAAVLKPDEVHAPSVSSSVVEEDAENTVDTASKPGLQERLQKHDISESVNFDEETDGISQSACLERPNSASSQNSTDTGTSGSATAAQPADNLLGDIDDLEDFVYSPAPQGVTVRCRIIRDKRGMDRGLFPTYYMYLEKEENQKIFLLAARKRKKSKTANYLISIDPVDLSREGESYVGKLRSNLMGTKFTVYDRGICPMKGRGLVGAAHTRQELAAISYETNVLGFKGPRKMSVIIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDKCIQTLRMQELCELHRQHHSAASLVHRTVCQRWVGHPWRLLPQTSLLWTDLSPPPVVPAPHQISM

SEQ ID NO: 37897 - protein, 133 aa, Homo sapiens
  ENSP00000441319
  MOD_RES (1)..(1): Any amino acid
XIPGMTLNHKQIPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDTDWPAPILVKSGCDHICDQL

SEQ ID NO: 37898 - protein, 109 aa, Homo sapiens
  ENSP00000440364
  MOD_RES (1)..(1): Any amino acid
XPYQPQNNHDSLLSRWQNRTMENLVELHNKAPVWNSDTQSYVLNFRGRVTQASVKNFQIVHKNDPDYIVMQFGRVADDVFTLDYNYPLCAVQAFGIGLSSFDRVPLTAI

SEQ ID NO: 37899 - protein, 48 aa, Homo sapiens
  ENSP00000489624
MVITSENDEDRGGQEKESKEESVLAMLGIIGTILNLIVIIFVYIYTTL

SEQ ID NO: 37900 - protein, 48 aa, Homo sapiens; identical to SEQ ID NO: 37899
  ENSP00000490254

SEQ ID NO: 37901 - protein, 347 aa, Homo sapiens
  ENSP00000371450
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 37902 - protein, 276 aa, Homo sapiens
  ENSP00000420829
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVMPLSPWGWFF

SEQ ID NO: 37903 - protein, 314 aa, Homo sapiens
  ENSP00000425777
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRTF

SEQ ID NO: 37904 - protein, 276 aa, Homo sapiens; identical to SEQ ID NO: 37902
  ENSP00000426973

SEQ ID NO: 37905 - protein, 289 aa, Homo sapiens
  ENSP00000423426
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLTS

SEQ ID NO: 37906 - protein, 348 aa, Homo sapiens
  ENSP00000424544
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 37907 - protein, 302 aa, Homo sapiens
  ENSP00000426880
NLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 37908 - protein, 338 aa, Homo sapiens
  ENSP00000222567
MAAGCSEAPRPAAASDGSLVGQAGVLPCLELPTYAAACALVNSRYSCLVAGPHQRHIALSPRYLNRKRTGIREQLDAELLRYSESLLGVPIAYDNIKVVGELGDIYDDQGHIHLNIEADFVIFCPEPGQKLMGIVNKVSSSHIGCLVHGCFNASIPKPEQLSAEQWQTMEINMGDELEFEVFRLDSDAAGVFCIRGKLNITSLQFKRSEVSEEVTENGTEEAAKKPKKKKKKKDPETYEVDSGTTKLADDADDTPMEESALQNTNNANGIWEEEPKKKKKKKKHQEVQDQDPVFQGSDSSGYQSDHKKKKKKRKHSEEAEFTPPLKCSPKRKGKSNFL

SEQ ID NO: 37909 - protein, 391 aa, Homo sapiens
  ENSP00000462521
MVMFKKIKSFEVVFNDPEKVYGSGEKVAGRVIVEVCEVTRVKAVRILACGVAKVLWMQGSQQCKQTSEYLRYEDTLLLEDQPTGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 37910 - protein, 336 aa, Homo sapiens
  ENSP00000396322
MPPKHSLSHRCILSVTASLMATRFSFPSGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 37911 - protein, 142 aa, Homo sapiens
  ENSP00000269601
MSYMLPHLHNGWQVDQAILSEEDRVVVIRFGHDWDPTCMKMDEVLYSIAEKVKNFAVIYLVDITEVPDFNKMYELYDPCTVMFFFRNKHIMIDLGTGNNNKINWAMEDKQEMVDIIETVYRGARKGRGLVVSPKDYSTKYRY

SEQ ID NO: 37912 - protein, 71 aa, Homo sapiens
  ENSP00000465572
MYELYDPCTVMFFFRNKHIMIDLGTGNNNKINWAMEDKQEMVDIIETVYRGARKGRGLVVSPKDYSTKYRY

SEQ ID NO: 37913 - protein, 57 aa, Homo sapiens
  ENSP00000465321
MSYMLPHLHNGWQVDQAILSEEDRVVVIRFGHDWDPTCMKMDEVLYSIAEKEQAHHD

SEQ ID NO: 37914 - protein, 71 aa, Homo sapiens; identical to SEQ ID NO: 37912
  ENSP00000465493

SEQ ID NO: 37915 - protein, 91 aa, Homo sapiens
  ENSP00000347678
MSYMLPHLHNGWQVDQAILSEEDRVVVIRFGHDWDPTCMKMDEVLYSIAEKVKNFAVIYLVDITEVPDFNKMYELYDPCTVMFFFSYHRGW

SEQ ID NO: 37916 - protein, 54 aa, Homo sapiens
  ENSP00000466266
MSYMLPHLHNGWQVDQAILSEEDRVVVIRFGHDWDPTCMKMDEVLYSIAEKVVA

SEQ ID NO: 37917 - protein, 71 aa, Homo sapiens; identical to SEQ ID NO: 37912
  ENSP00000468761

SEQ ID NO: 37918 - protein, 103 aa, Homo sapiens
  ENSP00000468493
MSYMLPHLHNGWQVDQAILSEEDRVVVIRFGHDWDPTCMKMDEVLYSIAEKVKNFAVIYLVDITEVPDFNKMYELYDPCTVMFFFRYVILKLLLKLNIVSLEA

SEQ ID NO: 37919 - protein, 54 aa, Homo sapiens; identical to SEQ ID NO: 37916
  ENSP00000467304

SEQ ID NO: 37920 - protein, 86 aa, Homo sapiens
  ENSP00000466694
MSYMLPHLHNGWQVDQAILSEEDRVVVIRFGHDWDPTCMKMDEVLYSIAEKFCRLYRKCGTGICFWGGLRTFQSWQKAKGNRHVAR

SEQ ID NO: 37921 - protein, 313 aa, Homo sapiens
  ENSP00000315644
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 37922 - protein, 230 aa, Homo sapiens
  ENSP00000314902
MPVAGSELPRRPLPPAAQERDAEPRPPHGELQYLGQIQHILRCGVRKDDRTGTGTLSVFGMQARYSLRDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 37923 - protein, 279 aa, Homo sapiens
  ENSP00000314727
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 37924 - protein, 167 aa, Homo sapiens
  ENSP00000418705
MQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 37925 - protein, 75 aa, Homo sapiens
  ENSP00000420672
MAEYLASIFGTEKDKVNCSFYFKIGACRHGDRCSRLHNKPTFSQTILIQNIYRNPQNSAQTADGSHYHCPLEHLP

SEQ ID NO: 37926 - protein, 240 aa, Homo sapiens
  ENSP00000369629
MAEYLASIFGTEKDKVNCSFYFKIGACRHGDRCSRLHNKPTFSQTILIQNIYRNPQNSAQTADGSHCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 37927 - protein, 240 aa, Homo sapiens
  ENSP00000291552
MAEYLASIFGTEKDKVNCSFYFKIGACRHGDRCSRLHNKPTFSQTIALLNIYRNPQNSSQSADGLRCAVSDVEMQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 37928 - protein, 45 aa, Homo sapiens
  ENSP00000489632
MAEYLASIFGTEKDKVNCSFYFKIGACRHGDRCSRLHNKPTFSQH

SEQ ID NO: 37929 - protein, 167 aa, Homo sapiens; identical to SEQ ID NO: 37924
  ENSP00000381205

SEQ ID NO: 37930 - protein, 505 aa, Homo sapiens
  ENSP00000356903
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRLKDANDVPIQCEISPLISYAGEGLESYVADKEFHAPLIIDENGVHELVKNGI

SEQ ID NO: 37931 - protein, 522 aa, Homo sapiens
  ENSP00000356902
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 37932 - protein, 521 aa, Homo sapiens
  ENSP00000356901
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRATNGKSETITADVNHNLKDANDVPIQCEISPLISYAGEGLESYVADKEFHAPLIIDENGVHELVKNGI

SEQ ID NO: 37933 - protein, 522 aa, Homo sapiens; identical to SEQ ID NO: 37931
  ENSP00000271469

SEQ ID NO: 37934 - protein, 649 aa, Homo sapiens
  ENSP00000284273
MAQYGHPSPLGMAAREELYSKVTPRRNRQQRPGTIKHGSALDVLLSMGFPRARAQKALASTGGRSVQAACDWLFSHVGDPFLDDPLPREYVLYLRPTGPLAQKLSDFWQQSKQICGKNKAHNIFPHITLCQFFMCEDSKVDALGEALQTTVSRWKCKFSAPLPLELYTSSNFIGLFVKEDSAEVLKKFAADFAAEAASKTEVHVEPHKKQLHVTLAYHFQASHLPTLEKLAQNIDVKLGCDWVATIFSRDIRFANHETLQVIYPYTPQNDDELELVPGDFIFMSPMEQTSTSEGWIYGTSLTTGCSGLLPENYITKADECSTWIFHGSYSILNTSSSNSLTFGDGVLERRPYEDQGLGETTPLTIICQPMQPLRVNSQPGPQKRCLFVCRHGERMDVVFGKYWLSQCFDAKGRYIRTNLNMPHSLPQRSGGFRDYEKDAPITVFGCMQARLVGEALLESNTIIDHVYCSPSLRCVQTAHNILKGLQQENHLKIRVEPGLFEWTKWVAGSTLPAWIPPSELAAANLSVDTTYRPHIPISKLVVSESYDTYISRSFQVTKEIISECKSKGNNILIVAHASSLEACTCQLQGLSPQNSKDFVQMVRKIPYLGFCSCEELGETGIWQLTDPPILPLTHGPTGGFNWRETLLQE

SEQ ID NO: 37935 - protein, 43 aa, Homo sapiens
  ENSP00000464594
MQIFVKTLTGKTITLEVEPSDTIENVKAKIQDKEGIPPDQQRL

SEQ ID NO: 37936 - protein, 229 aa, Homo sapiens
  ENSP00000304697
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 37937 - protein, 206 aa, Homo sapiens
  ENSP00000463156
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGR

SEQ ID NO: 37938 - protein, 153 aa, Homo sapiens
  ENSP00000437475
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGC

SEQ ID NO: 37939 - protein, 229 aa, Homo sapiens; identical to SEQ ID NO: 37936
  ENSP00000379180

SEQ ID NO: 37940 - protein, 229 aa, Homo sapiens; identical to SEQ ID NO: 37936
  ENSP00000379178

SEQ ID NO: 37941 - protein, 93 aa, Homo sapiens
  ENSP00000464510
MQIFVKTLTGKTITLEVEPSDTIENVKAKIQDKEGIPPDQQRLIFAGKQLEDGRTLSDYNIQKESTLHLVLRLRGGMQIFVKTLTGKTITLEV

SEQ ID NO: 37942 - protein, 229 aa, Homo sapiens; identical to SEQ ID NO: 37936
  ENSP00000478771

SEQ ID NO: 37943 - protein, 685 aa, Homo sapiens
  ENSP00000441543
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 37944 - protein, 305 aa, Homo sapiens
  ENSP00000443053
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 37945 - protein, 685 aa, Homo sapiens; identical to SEQ ID NO: 37943
  ENSP00000344818

SEQ ID NO: 37946 - protein, 169 aa, Homo sapiens
  ENSP00000440205
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEV

SEQ ID NO: 37947 - protein, 160 aa, Homo sapiens
  ENSP00000442800
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTL

SEQ ID NO: 37948 - protein, 155 aa, Homo sapiens
  ENSP00000445337
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQI

SEQ ID NO: 37949 - protein, 149 aa, Homo sapiens
  ENSP00000439492
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRL

SEQ ID NO: 37950 - protein, 136 aa, Homo sapiens
  ENSP00000438289
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYN

SEQ ID NO: 37951 - protein, 134 aa, Homo sapiens
  ENSP00000441238
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSD

SEQ ID NO: 37952 - protein, 122 aa, Homo sapiens
  ENSP00000437452
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFA

SEQ ID NO: 37953 - protein, 61 aa, Homo sapiens
  ENSP00000441556
MQIFVKTLTGKTITLEVEPSDTIENVKAKIQDKEGIPPDQQRLIFAGKQLEDGRTLSDYNI

SEQ ID NO: 37954 - protein, 229 aa, Homo sapiens
  ENSP00000438394
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 37955 - protein, 152 aa, Homo sapiens
  ENSP00000265339
MSTPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQSLLDEPNPNSPANSQAAQLYQENKREYEKRVSAIVEQSWNDS

SEQ ID NO: 37956 - protein, 44 aa, Homo sapiens
  ENSP00000425237
MSTPARRRLMRDFKRLQEDPPVGVSGAPSENNIMQWNAVIFGVC

SEQ ID NO: 37957 - protein, 138 aa, Homo sapiens
  ENSP00000426364
STPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQCLALLPRLECNGTILAHRNLCLPGSISAG

SEQ ID NO: 37958 - protein, 141 aa, Homo sapiens
  ENSP00000425137
  MOD_RES (1)..(1): Any amino acid
XPARRRLMRDFKRLQEDPPVGVSGAPSENNIMQWNAVIFGPEGTPFEDGTFKLVIEFSEEYPNKPPTVRFLSKMFHPNDILQNRWSPTYDVSSILTSIQSLLDEPNPNSPANSQAAQLYQENKREYEKRVSAIVEQSWNDS

SEQ ID NO: 37959 - protein, 161 aa, Homo sapiens
  ENSP00000382713
MKELQDIARLSDRFISVELVDESLFDWNVKLHQVDKDSVLWQDMKETNTEFILLNLTFPDNFPFSPPFMRVLSPRLENGYVLDGGAICMELLTPRGWSSAYTVEAVMRQFAASLVKGQGRICRKAGKSKKSFSRKEAEATFKSLVKTHEKYGWVTPPVSDG

SEQ ID NO: 37960 - protein, 1066 aa, Homo sapiens
  ENSP00000252108
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAHFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 37961 - protein, 1073 aa, Homo sapiens
  ENSP00000387362
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAREYMNKIYFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 37962 - protein, 538 aa, Homo sapiens
  ENSP00000438918
MVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 37963 - protein, 309 aa, Homo sapiens
  ENSP00000312029
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 37964 - protein, 225 aa, Homo sapiens
  ENSP00000441147
MVGFKATDVPPTATVKFLGAGTAACIADLITFPLDTAKVRLQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTGSCPPFSAWVPGTW

SEQ ID NO: 37965 - protein, 282 aa, Homo sapiens
  ENSP00000439951
GQHAYPCSYPVLALQIQGESQGPVRATASAQYRGVMGTILTMVRTEGPRSLYNGLVAGLQRQMSFASVRIGLYDSVKQFYTKGSEHASIGSRLLAGSTTGALAVAVAQPTDVVKVRFQAQARAGGGRRYQSTVNAYKTIAREEGFRGLWKGTSPNVARNAIVNCAELVTYDLIKDALLKANLMTDDLPCHFTSAFGAGFCTTVIASPVDVVKTRYMNSALGQYSSAGHCALTMLQKEGPRAFYKGFMPSFLRLGSWNVVMFVTYEQLKRALMAACTSREAPF

SEQ ID NO: 37966 - protein, 129 aa, Homo sapiens
  ENSP00000439706
GSRLLAGSTTGALAVAVAQPTDVVKVRFQAQARAGGGRRYQSTVNAYKTIAREEGFRGLWKGTSPNVARNAIVNCAELVTYDLIKDALLKANLMTGFCTTVIASPVDVVKTRYMNSALGQYSSAGHCAL

SEQ ID NO: 37967 - protein, 32 aa, Homo sapiens
  ENSP00000438230
MVGFKATDVPPTATVKFLGAGTAACIADLITF

SEQ ID NO: 37968 - protein, 794 aa, Homo sapiens
  ENSP00000358283
MADAWEEIRRLAADFQRAQFAEATQRLSERNCIEIVNKLIAQKQLEVVHTLDGKEYITPAQISKEMRDELHVRGGRVNIVDLQQVINVDLIHIENRIGDIIKSEKHVQLVLGQLIDENYLDRLAEEVNDKLQESGQVTISELCKTYDLPGNFLTQALTQRLGRIISGHIDLDNRGVIFTEAFVARHKARIRGLFSAITRPTAVNSLISKYGFQEQLLYSVLEELVNSGRLRGTVVGGRQDKAVFVPDIYSRTQSTWVDSFFRQNGYLEFDALSRLGIPDAVSYIKKRYKTTQLLFLKAACVGQGLVDQVEASVEEAISSGTWVDIAPLLPTSLSVEDAAILLQQVMRAFSKQASTVVFSDTVVVSEKFINDCTELFRELMHQKAEKEMKNNPVHLITEEDLKQISTLESVSTSKKDKKDERRRKATEGSGSMRGGGGGNAREYKIKKVKKKGRKDDDSDDESQSSHTGKKKPEISFMFQDEIEDFLRKHIQDAPEEFISELAEYLIKPLNKTYLEVVRSVFMSSTTSASGTGRKRTIKDLQEEVSNLYNNIRLFEKGMKFFADDTQAALTKHLLKSVCTDITNLIFNFLASDLMMAVDDPAAITSEIRKKILSKLSEETKVALTKLHNSLNEKSIEDFISCLDSAAEACDIMVKRGDKKRERQILFQHRQALAEQLKVTEDPALILHLTSVLLFQFSTHSMLHAPGRCVPQIIAFLNSKIPEDQHALLVKYQGLVVKQLVSQSKKTGQGDYPLNNELDKEQEDVASTTRKELQELSSSIKDLVLKSRKSSVTEE

SEQ ID NO: 37969 - protein, 87 aa, Homo sapiens
  ENSP00000423599
MVISESMDILFRIRGGLDLAFQLATPNEIFLKKALKHVLSDLSTKLSSNALVFRICHSSVYIWPSSDINTIPGELTDASAYLSQKKI

SEQ ID NO: 37970 - protein, 469 aa, Homo sapiens
  ENSP00000264689
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 37971 - protein, 387 aa, Homo sapiens
  ENSP00000421133
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSNTRKNKKVGNIVS

SEQ ID NO: 37972 - protein, 368 aa, Homo sapiens
  ENSP00000425855
  MOD_RES (1)..(1): Any amino acid
XFRFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 37973 - protein, 197 aa, Homo sapiens
  ENSP00000423657
  MOD_RES (1)..(1): Any amino acid
XMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKHLEFEVYKRFFDWCMYLTEYSSNILVL

SEQ ID NO: 37974 - protein, 112 aa, Homo sapiens
  ENSP00000424419
MVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDML

SEQ ID NO: 37975 - protein, 124 aa, Homo sapiens
  ENSP00000423108
MDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAV

SEQ ID NO: 37976 - protein, 1516 aa, Homo sapiens
  ENSP00000365938
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 37977 - protein, 280 aa, Homo sapiens
  ENSP00000365902
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKLVY

SEQ ID NO: 37978 - protein, 278 aa, Homo sapiens
  ENSP00000365904
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKS

SEQ ID NO: 37979 - protein, 278 aa, Homo sapiens; identical to SEQ ID NO: 37978
  ENSP00000482021

SEQ ID NO: 37980 - protein, 372 aa, Homo sapiens
  ENSP00000380743
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARLRMNILICLFQSTLNVKNLRSRHLYNKT

SEQ ID NO: 37981 - protein, 280 aa, Homo sapiens [sequence omitted]

SEQ ID NO: 37982 - protein, 541 aa, Homo sapiens
  ENSP00000311648
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETIYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 37983 - protein, 141 aa, Homo sapiens
  ENSP00000421446
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPND

SEQ ID NO: 37984 - protein, 541 aa, Homo sapiens; identical to SEQ ID NO: 37982
  ENSP00000378019

SEQ ID NO: 37985 - protein, 2214 aa, Homo sapiens
  ENSP00000260323
MVANFFKSLILPYIHKLCKGMFTKKLGNTNKNKEYRQQKKDQDFPTAGQTKSPKFSYTFKSTVKKIAKCSSTHNLSTEEDEASKEFSLSPTFSYRVAIANGLQKNAKVTNSDNEDLLQELSSIESSYSESLNELRSSTENQAQSTHTMPVRRNRKSSSSLAPSEGSSDGERTLHGLKLGALRKLRKWKKSQECVSSDSELSTMKKSWGIRSKSLDRTVRNPKTNALEPGFSSSGCISQTHDVMEMIFKELQGISQIETELSELRGHVNALKHSIDEISSSVEVVQSEIEQLRTGFVQSRRETRDIHDYIKHLGHMGSKASLRFLNVTEERFEYVESVVYQILIDKMGFSDAPNAIKIEFAQRIGHQRDCPNAKPRPILVYFETPQQRDSVLKKSYKLKGTGIGISTDILTHDIRERKEKGIPSSQTYESMAIKLSTPEPKIKKNNWQSPDDSDEDLESDLNRNSYAVLSKSELLTKGSTSKPSSKSHSARSKNKTANSSRISNKSDYDKISSQLPESDILEKQTTTHYADATPLWHSQSDFFTAKLSRSESDFSKLCQSYSEDFSENQFFTRTNGSSLLSSSDRELWQRKQEGTATLYDSPKDQHLNGGVQGIQGQTETENTETVDSGMSNGMVCASGDRSHYSDSQLSLHEDLSPWKEWNQGADLGLDSSTQEGFDYETNSLFDQQLDVYNKDLEYLGKCHSDLQDDSESYDLTQDDNSSPCPGLDNEPQGQWVGQYDSYQGANSNELYQNQNQLSMMYRSQSELQSDDSEDAPPKSWHSRLSIDLSDKTFSFPKFGSTLQRAKSALEVVWNKSTQSLSGYEDSGSSLMGRFRTLSQSTANESSTTLDSDVYTEPYYYKAEDEEDYTEPVADNETDYVEVMEQVLAKLENRTSITETDEQMQAYDHLSYETPYETPQDEGYDGPADDMVSEEGLEPLNETSAEMEIREDENQNIPEQPVEITKPKRIRPSFKEAALRAYKKQMAELEEKILAGDSSSVDEKARIVSGNDLDASKFSALQVCGGAGGGLYGIDSMPDLRRKKTLPIVRDVAMTLAARKSGLSLAMVIRTSLNNEELKMHVFKKTLQALIYPMSSTIPHNFEVWTATTPTYCYECEGLLWGIARQGMKCLECGVKCHEKCQDLLNADCLQRAAEKSSKHGAEDKTQTIITAMKERMKIREKNRPEVFEVIQEMFQISKEDFVQFTKAAKQSVLDGTSKWSAKITITVVSAQGLQAKDKTGSSDPYVTVQVGKNKRRTKTIFGNLNPVWDEKFYFECHNSTDRIKVRVWDEDDDIKSRVKQHFKKESDDFLGQTIVEVRTLSGEMDVWYNLEKRTDKSAVSGAIRLKINVEIKGEEKVAPYHIQYTCLHENLFHYLTEVKSNGGVKIPEVKGDEAWKVFFDDASQEIVDEFAMRYGIESIYQAMTHFSCLSSKYMCPGVPAVMSTLLANINAFYAHTTVSTNIQVSASDRFAATNFGREKFIKLLDQLHNSLRIDLSKYRENFPASNTERLQDLKSTVDLLTSITFFRMKVLELQSPPKASMVVKDCVRACLDSTYKYIFDNCHELYSQLTDPSKKQDIPREDQGPTTKNLDFWPQLITLMVTIIDEDKTAYTPVLNQFPQELNMGKISAEIMWTLFALDMKYALEEHENQRLCKSTDYMNLHFKVKWFYNEYVRELPAFKDAVPEYSLWFEPFVMQWLDENEDVSMEFLHGALGRDKKDGFQQTSEHALFSCSVVDVFAQLNQSFEIIKKLECPNPEALSHLMRRFAKTINKVLLQYAAIVSSDFSSHCDKENVPCILMNNIQQLRVQLEKMFESMGGKELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIVLPPLTDQTGPQMIFIAAKDLGQLSKLKEHMIREDARGLTPRQCAIMEVVLATIKQYFHAGGNGLKKNFLEKSPDLQSLRYALSLYTQTTDALIKKFIDTQTSQSRSSKDAVGQISVHVDITATPGTGDHKVTVKVIAINDLNWQTTAMFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 37986 - protein, 178 aa, Homo sapiens
  ENSP00000453018
  MOD_RES (1)..(1): Any amino acid
XAKTINKVLLQYAAIVSSDFSSHCDKENVPCILMNNIQQLRVQLEKMFESMGGKEKKEGERFFYELDSEASTILKELQVKLSGVLDELSVTYGESFQVIIEECIKQMSFELNQMRANGNTTSNKNSAAMDAEIVLRSLMDFLDKTLSLSAKICEKTVLKRVLKELWKLVLNKIEKQIV

SEQ ID NO: 37987 - protein, 135 aa, Homo sapiens
  ENSP00000443886
MFRPFVEVCILGPNLGDKKRKQGTKTKSNTWSPKYNETFQFILGKENRPGAYELHLSVKDYCFAREDRIIGMTVIQLQNIAEKGSYGAWYPLLKNISMDETGLTILRILSQRTSDDVAKEFVRLKSETRSTEESA

SEQ ID NO: 37988 - protein, 20 aa, Homo sapiens
  ENSP00000456350
MFRPFVEVCILGPNLGDKKR

SEQ ID NO: 37989 - protein, 945 aa, Homo sapiens
  ENSP00000334329
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQNKKTLSDPNSHLLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 37990 - protein, 934 aa, Homo sapiens
  ENSP00000362288
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQMLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 37991 - protein, 953 aa, Homo sapiens
  ENSP00000385143
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 37992 - protein, 886 aa, Homo sapiens
  ENSP00000392739
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVDGSWEVWSEWSVCSPECEHLRIRECTAPPPRNGGKFCEGLSQESENCTDGLCILGIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 37993 - protein, 884 aa, Homo sapiens
  ENSP00000287272
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 37994 - protein, 958 aa, Homo sapiens
  ENSP00000412652
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQRWSRRGIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 37995 - protein, 948 aa, Homo sapiens
  ENSP00000394303
MILVLVKALSDVCAGTSGFLLDFSSQTSPGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 37996 - protein, 529 aa, Homo sapiens
  ENSP00000397211
MELMIQEKSFGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 37997 - protein, 3234 aa, Homo sapiens
  ENSP00000272845
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIKESDLTFRLASGLVIWQPMWEHRQPGVSGFTALVKPIRNIITAKRSSPINSQSRTCESPNQDARHLEGLQVVCETFQSDSISPKATISGCHRGNSFDGSLSSQTSQERGPSHSRASLVIPPCQRSRYATYFDVAVLRCLLQPHWSEEGTQWSLMYYLQRLRHMLEEKPEKPPEPDIPLLPRPRSSSMVAAAPSLVNTHKTQDLTMKCNEEEKSLSSEAFSKVSLTNLRRSAVPDLSSDLGMNIFKKFKSRKEDRERKGSIPFHHTGKRRPRRMGVPFLLHEDHLDVSPTRSTFSFGSFSGLGEDRRGIEKGGWQTTILGKLTRRGSSDAATEMESLSARHSHSHHTLVSDLPDPSNSHGENTVKEVRSQISTITVATFNTTLASFNVGYADFFNEHMRKLCNQVPIPEMPHEPLACANLPRSLTDSCINYSYLEDTEHIDGTNNFVHKNGMLDLSVVLKAVYLVLNHDISSRICDVALNIVECLLQLGVVPCVEKNRKKSENKENETLEKRPSEGAFQFKGVSGSSTCGFGGPAVSGAGDGGGEEGGGGDGGGGGGDGGGGGGGGGGPYEKNDKNQEKDESTPVSNHRLALTMLIKIVKSLGCAYGCGEGHRGLSGDRLRHQAQNCLTKLYKLDKMQFRQTMRDYVNKDSLNNVVDFLHALLGFCMEPVTDNKAGFGNNFTTVDNKSTAQNVEGIIVSAMFKSLITRCASTTHELHSPENLGLYCDIRQLVQFIKEAHGNVFRRVALSALLDSAEKLAPGKKVEENEQESKPAGSKRSEAGSIVDKGQVSSAPEECRSFMSGRPSQTPEHDEQMQGANLGRKDFWRKMFKSQSAASDTSSQSEQDTSECTTAHSGTTSDRRARSRSRRISLRKKLKLPIGKRNWLKRSSLSGLADGVEDLLDISSVDRLSFIRQSSKVKFTSAVKLSEGGPGSGMENGRDEEENFFKRLGCHSFDDHLSPNQDGGKSKNVVNLGAIRQGMKRFQFLLNCCEPGTIPDASILAAALDLEAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSKSFSARAVSRSHQRAEHILKNLQQEEEKKRLGREASLITAIPITQEACYEPTCTPNSEPEEEVEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQRVASIQSEPGQQNLLVQQPLGRKRGLRQLRRPLLSRQKTQTEPRNRQGARLSTTRRSIQPKTKPSADQKRSVTFIEAQPEPAAAPTDALPATGQLQGCSPAPSRKPEAMDEPVLTSSPAIVVADLHSVSPKQSENFPTEEGEKEEDTEAQGATAHSPLSAQLSDPDDFTGLETSSLLQHGDTVLHISEENGMENPLLSSQFTFTPTELGKTDAVLDESHV

SEQ ID NO: 37998 - protein, 546 aa, Homo sapiens
  ENSP00000335576
IPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQR

SEQ ID NO: 37999 - protein, 3258 aa, Homo sapiens
  ENSP00000391088
MVKRKSSEGQEQDGGRGIPLPIQTFLWRQTSAFLRPKLGKQYEASCVSFERVLVENKLHGLSPALSEAIQSISRWELVQAALPHVLHCTATLLSNRNKLGHQDKLGVAETKLLHTLHWMLLEAPQDCNNERFGGTDRGSSWGGSSSAFIHQVENQGSPGQPCQSSSNDEEENNRRKIFQNSMATVELFVFLFAPLVHRIKESDLTFRLASGLVIWQPMWEHRQPGVSGFTALVKPIRNIITAKRSSPINSQSRTCESPNQDARHLEGLQVVCETFQSDSISPKATISGCHRGNSFDGSLSSQTSQERGPSHSRASLVIPPCQRSRYATYFDVAVLRCLLQPHWSEEGTQWSLMYYLQRLRHMLEEKPEKPPEPDIPLLPRPRSSSMVAAAPSLVNTHKTQDLTMKCNEEEKSLSSEAFSKVSLTNLRRSAVPDLSSDLGMNIFKKFKSRKEDRERKGSIPFHHTGKRRPRRMGVPFLLHEDHLDVSPTRSTFSFGSFSGLGEDRRGIEKGGWQTTILGKLTRRGSSDAATEMESLSARHSHSHHTLVSDLPDPSNSHGENTVKEVRSQISTITVATFNTTLASFNVGYADFFNEHMRKLCNQVPIPEMPHEPLACANLPRSLTDSCINYSYLEDTEHIDGTNNFVHKNGMLDLSVVLKAVYLVLNHDISSRICDVALNIVECLLQLGVVPCVEKNRKKSENKENETLEKRPSEGAFQFKGVSGSSTCGFGGPAVSGAGDGGGEEGGGGDGGGGGGDGGGGGGGGGGPYEKNDKNQEKDESTPVSNHRLALTMLIKIVKSLGCAYGCGEGHRGLSGDRLRHQVFRENAQNCLTKLYKLDKMQFRQTMRDYVNKDSLNNVVDFLHALLGFCMEPVTDNKAGFGNNFTTVDNKSTAQNVEGIIVSAMFKSLITRCASTTHELHSPENLGLYCDIRQLVQFIKEAHGNVFRRVALSALLDSAEKLAPGKKVEENEQESKPAGSKRSEAGSIVDKGQVSSAPEECRSFMSGRPSQTPEHDEQMQGANLGRKDFWRKMFKSQSAASDTSSQSEQDTSECTTAHSGTTSDRRARSRSRRISLRKKLKLPIGKRNWLKRSSLSGLADGVEDLLDISSVDRLSFIRQSSKVKFTSAVKLSEGGPGSGMENGRDEEENFFKRLGCHSFDDHLSPNQDGGKSKNVVNLGAIRQGMKRFQFLLNCCEPGTIPDASILAAALDLEAPVVARAALFLECARFVHRCNRGNWPEWMKGHHVNITKKGLSRGRSPIVGNKRNQKLQWNAAKLFYQWGDAIGVRLNELCHGESESPANLLGLIYDEETKRRLRKEDEEEDFLDDSTVNPSKCGCPFALKMAACQLLLEITTFLRETFSCLPRPRTEPLVDLESCRLRLDPELDRHRYERKISFAGVLDENEDSKDSLHSSSHTLKSDAGVEEKKEGSPWSASEPSIEPEGMSNAGAEENYHRNMSWLHVMILLCNQQSFICTHVDYCHPHCYLHHSRSCARLVRAIKLLYGDSVDSLRESSNISSVALRGKKQKECSDKSCLRTPSLKKRVSDANLEGKKDSGMLKYIRLQVMSLSPAPLSLLIKAAPILTEEMYGDIQPAAWELLLSMDEHMAGAAAAMFLLCAVKVPEAVSDMLMSEFHHPETVQRLNAVLKFHTLWRFRYQVWPRMEEGAQQIFKIPPPSINFTLPSPVLGMPSVPMFDPPWVPQCSGSVQDPINEDQSKSFSARAVSRSHQRAEHILKNLQQEEEKKRLGREASLITAIPITQEACYEPTCTPNSEPEEEVEEVTNLASRRLSVSPSCTSSTSHRNYSFRRGSVWSVRSAVSAEDEEHTTEHTPNHHVPQPPQAVFPACICAAVLPIVHLMEDGEVREDGVAVSAVAQQVLWNCLIEDPSTVLRHFLEKLTISNRQDELMYMLRKLLLNIGDFPAQTSHILFNYLVGLIMYFVRTPCEWGMDAISATLTFLWEVVGYVEGLFFKDLKQTMKKEQCEVKLLVTASMPGTKTLVVHGQNECDIPTQLPVHEDTQFEALLKECLEFFNIPESQSTHYFLMDKRWNLIHYNKTYVRDIYPFRRSVSPQLNLVHMHPEKGQELIQKQVFTRKLEEVGRVLFLISLTQKIPTAHKQSHVSMLQEDLLRLPSFPRSAIDAEFSLFSDPQAGKELFGLDTLQKSLWIQLLEEMFLGMPSEFPWGDEIMLFLNVFNGALILHPEDSALLRQYAATVINTAVHFNHLFSLSGYQWILPTMLQVYSDYESNPQLRQAIEFACHQFYILHRKPFVLQLFASVAPLLEFPDAANNGPSKGVSAQCLFDLLQSLEGETTDILDILELVKAEKPLKSLDFCYGNEDLTFSISEAIKLCVTVVAYAPESFRSLQMLMVLEALVPCYLQKLKRQTSQVETVPAAREEIAATAALATSLQALLYSVEVLTRPMTAPQMSRCDQGHKGTTTANHTMSSGVNTRYQEQGAKLHFIRENLHLLEEGQGIPREELDERIAREEFRRPRESLLNICTEFYKHCGPRLKILQNLAGEPRVIALELLDVKSHMRLAEIAHSLLKLAPYDTQTMESRGLRRYIMEMLPITDWTAEAVRPALILILKRLDRMFNKIHKMPTLRRQVEWEPASNLIEGVCLTLQRQPIISFLPHLRSLINVCVNLVMGVVGPSSVADGLPLLHLSPYLSPPLPFSTAVVRLVALQIQALKEDFPLSHVISPFTNQERREGMLLNLLIPFVLTVGSGSKDSPWLEQPEVQLLLQTVINVLLPPRIISTSRSKNFMLESSPAHCSTPGDAGKDLRREGLAESTSQAAYLALKVILVCFERQLGSQWYWLSLQVKEMALRKVGGLALWDFLDFIVRTRIPIFVLLRPFIQCKLLAQPAENHEELSARQHIADQLERRFIPRPLCKSSLIAEFNSELKILKEAVHSGSAYQGKTSISTVGTSTSAYRLSLATMSRSNTGTGTVWEQDSEPSQQASQDTLSRTDEEDEENDSISMPSVVSEQEAYLLSAIGRRRFSSHVSSMSVPQAEVGMLPSQSEPNVLDDSQGLAAEGSLSRVASIQSEPGQQNLLVQQPLGRKRGLRQLRRPLLSRQKTQTEPRNRQGARLSTTRRSIQPKTKPSADQKRSVTFIEAQPEPAAAPTDALPATGQLQGCSPAPSRKPEAMDEPVLTSSPAIVVADLHSVSPKQSENFPTEEGEKEEDTEAQGATAHSPLSAQLSDPDDFTGLETSSLLQHGDTVLHISEENGMENPLLSSQFTFTPTELGKTDAVLDESHV

SEQ ID NO: 38000 - protein, 531 aa, Homo sapiens
  ENSP00000314480
MMDGRLLEHPHAQFGGSLGGVVGFPYPLGHHHVYELAGHQLQSAAAAASVPFSIDGLLGGSCAAAASVVNPTPLLPAACGVGGDGQPFKLSDSGDPDKESPGCKRRRTRTNFTGWQLEELEKAFNESHYPDVFMREALALRLDLVESRVQVWFQNRRAKWRKKENTKKGPGRPAHNSHPTTCSGEPMDPEEIARKELEKMEKKKRKHEKKLLKSQGRHLHSPGGLSLHSAPSSDSDSGGGGLSPEPPEPPPPAAKGPGAHASGAAGTAPAPPGEPPAPGTCDPAFYPSQRSGAGPQPRPGRPADKDAASCGPGAAVAAVERGAAGLPKASPFSVESLLSDSPPRRKAASNAAAAAAAGLDFAPGLPCAPRTLIGKGHFLLYPITQPLGFLVPQAALKGGAGLEPAPKDAPPAPAVPPAPPAQASFGAFSGPGGAPDSAFARRSPDAVASPGAPAPAPAPFRDLASAAATEGGGGDCADAGTAGPAPPPPAPSPRPGPRPPSPAEEPATCGVPEPGAAAGPSPPEGEELDMD

SEQ ID NO: 38001 - protein, 144 aa, Homo sapiens
  ENSP00000405209
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGG

SEQ ID NO: 38002 - protein, 310 aa, Homo sapiens
  ENSP00000330032
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 38003 - protein, 29 aa, Homo sapiens
  ENSP00000387607
MAATGANAEKAESHNDCPVRLLNPNIAKM

SEQ ID NO: 38004 - protein, 36 aa, Homo sapiens
  ENSP00000408899
MAATGANAEKAESHKSGARHCGHNRAGSGYLLQGRV

SEQ ID NO: 38005 - protein, 171 aa, Homo sapiens
  ENSP00000414963
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGILKHLRRKDTGKSKGGRERRSTKLR

SEQ ID NO: 38006 - protein, 310 aa, Homo sapiens; identical to SEQ ID NO: 38002
  ENSP00000378931

SEQ ID NO: 38007 - protein, 146 aa, Homo sapiens
  ENSP00000390118
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIG

SEQ ID NO: 38008 - protein, 36 aa, Homo sapiens; identical to SEQ ID NO: 38004
  ENSP00000378927

SEQ ID NO: 38009 - protein, 85 aa, Homo sapiens
  ENSP00000396820
MAATGANAEKAESHNDCPVRLLNPNIAKMKEDILYHFNLTTSRHNFPALFGDVKFVCVGGSPSRMKAFISMVWAFLLSQSCCMSS

SEQ ID NO: 38010 - protein, 36 aa, Homo sapiens; identical to SEQ ID NO: 38004
  ENSP00000413611

SEQ ID NO: 38011 - protein, 920 aa, Homo sapiens
  ENSP00000366311
MATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 38012 - protein, 49 aa, Homo sapiens
  ENSP00000366282
METRKKDGTWPSAQLHVMNNNMSEEDEDFKGQPGICGLTNLGNTCFMNS

SEQ ID NO: 38013 - protein, 140 aa, Homo sapiens
  ENSP00000366279
METRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLH

SEQ ID NO: 38014 - protein, 963 aa, Homo sapiens
  ENSP00000218348
MAVAPRLFGGLCFRFRDQNPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLYDTHITVLDAALETGQLIIMETRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 38015 - protein, 1077 aa, Homo sapiens
  ENSP00000003302
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEVMLSPAMQGVILAIAKARQTFDRDGSEAGLIKAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 38016 - protein, 753 aa, Homo sapiens
  ENSP00000442431
MSFLKSLSLCLGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 38017 - protein, 920 aa, Homo sapiens
  ENSP00000444991
MHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 38018 - protein, 194 aa, Homo sapiens
  ENSP00000441513
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQDASSGVPPCRPERVFI

SEQ ID NO: 38019 - protein, 194 aa, Homo sapiens
  ENSP00000440260
  MOD_RES (1)..(1): Any amino acid
XNWRFEQEVEEWEEEQSCKIPQMESSTNSSSQDYSTSQEPSVASSHGVRCLSSEHAVIVKEQTAQAIANTARAYEKSGVEAALSELKEAEPKKPMPQETNLAEQSEQPPKANDAESTAQPNSEVMLSPAMQGVILAIAKARQTFDRDGSEAGLIKAFHEEYSRLYQLAKETPTSHSDPRLQHVLVYFFQNEAPK

SEQ ID NO: 38020 - protein, 360 aa, Homo sapiens
  ENSP00000442257
AALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFN

SEQ ID NO: 38021 - protein, 583 aa, Homo sapiens
  ENSP00000445743
MTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVE

SEQ ID NO: 38022 - protein, 51 aa, Homo sapiens
  ENSP00000438050
  MOD_RES (1)..(1): Any amino acid
XRNIMFMQELQYLFALMMGSNRKFVDPSAALDLLKGAFRSSEEQQQSQEQI

SEQ ID NO: 38023 - protein, 40 aa, Homo sapiens
  ENSP00000437688
  MOD_RES (1)..(1): Any amino acid
XFALMMGSNRKFVDPSAALDLLKGAFRSSEEQQQQSQEQI

SEQ ID NO: 38024 - protein, 91 aa, Homo sapiens
  ENSP00000445722
  MOD_RES (1)..(1): Any amino acid
XNPELSPFPKSSSPRNKSENPMVQLFYGTFLTEGVREGKPFCNNETFGQYPLQVNGYRNLDECLEGAMVEGDVELLPSDHSVKYGQEPTCT

SEQ ID NO: 38025 - protein, 244 aa, Homo sapiens
  ENSP00000440799
CGAAAGRRGRRGRRPRLEVIDLTHDNKDDLQAAIALSLLESPKIQADGRDLNRMHEATSAETKRSKRKRCEVWGENPNPNDWRRVDGWPVGLKNVGNTCWFSAVIQEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSD

SEQ ID NO: 38026 - protein, 77 aa, Homo sapiens
  ENSP00000446284
MRNYICRTKLADRYPQSCQMLLNQLREITGIQDPSFLHEALKASNGDITQAVSLLTDERVKEPSQDTVATEPSEVEG

SEQ ID NO: 38027 - protein, 46 aa, Homo sapiens
  ENSP00000437450
MRNYICRTKLADRYPQSCQMLLNQLREITGIQDPSFLHEALKASNG

SEQ ID NO: 38028 - protein, 979 aa, Homo sapiens
  ENSP00000258399
MSPLKIHGPIRIRSMQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAISRPLKASQMVNSCITSPSTPSKKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDELLETEKNSQSLSTEVGKTTRQAL

SEQ ID NO: 38029 - protein, 979 aa, Homo sapiens; identical to SEQ ID NO: 38028
  ENSP00000393662

SEQ ID NO: 38030 - protein, 885 aa, Homo sapiens
  ENSP00000400902
MLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRTNVSSQTPSAKRSLGFLPQPVPLSVKKLRCNQDYTGWNKPRVPLSSHQQQQLQGFSNLGNTCYMNAILQSLFSLQSFANDLLKQGIPWKKIPLNALIRRFAHLLVKKDICNSETKKDLLKKVKNAISATAERFSGYMQNDAHEFLSQCLDQLKEDMEKLNKTWKTEPVSGEENSPDISATRAYTCPVITNLEFEVQHSIICKACGEIIPKREQFNDLSIDLPRRKKPLPPRSIQDSLDLFFRAEELEYSCEKCGGKCALVRHKFNRLPRVLILHLKRYSFNVALSLNNKIGQQVIIPRYLTLSSHCTENTKPPFTLGWSAHMAMKFTFKSKSSLALCLDSDSEDELKRSVALSQRLCEMLGNEQQQEDLEKDSKLCPIEPDKSELENSGFDRMSEEELLAAVLEISKRDASPSLSHEDDDKPTSSPDTGFAEDDIQEMPENPDTMETEKPKTITELDPASFTEITKDCDENKENKTPEGSQGEVDWLQQYDMEREREEQELQQALAQSLQEQEAWEQKEDDDLKRATELSLQEFNNSFVDALGSDEDSGNEDVFDMEYTEAEAEELKRNAETGNLPHSYRLISVVSHIGSTSSSGHYISDVYDIKKQAWFTYNDLEVSKIQEAAVQSDRDRSGYIFFYMHKEIFDELLETEKNSQSLSTEVGKTTRQAL

SEQ ID NO: 38031 - protein, 979 aa, Homo sapiens; identical to SEQ ID NO: 38028
  ENSP00000396585

SEQ ID NO: 38032 - protein, 302 aa, Homo sapiens
  ENSP00000345043
MSPLKIHGPIRIRSMQTGITKWKEGSFEIVEKENKVSLVVHYNTGGIPRIFQLSHNIKNVVLRPSGAKQSRLMLTLQDNSFLSIDKVPSKDAEEMRLFLDAVHQNRLPAAMKPSQGSGSFGAILGSRTSQKETSRQLSYSDNQASAKRGSLETKDDIPFRKVLGNPGRGSIKTVAGSGIARTIPSLTSTSTPLRSGLLENRTEKRKRMISTGSELNEDYPKENDSSSNNKAMTDPSRKYLTSSREKQLSLKQSEENRTSGLLPLQSSSFYGSRAGSKEHSSGGTNLDRFIGYKYIRYLLSTC

SEQ ID NO: 38033 - protein, 916 aa, Homo sapiens
  ENSP00000341028
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSNGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 38034 - protein, 963 aa, Homo sapiens
  ENSP00000265560
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKSSTAPSRNFTTSPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVKKKPYLELKDANGRPDAVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHYTAYAKNKLNGKWYYFDDSNVSLASEDQIVTKAAYVLFYQRRDDEFYKTPSLSSSGSSDGGTRPSSSQQGFGDDEACSMDTN

SEQ ID NO: 38035 - protein, 621 aa, Homo sapiens
  ENSP00000399079
  MOD_RES (1)..(1): Any amino acid
XPKSSASPYSSVSASLIANGDSTSTCGMHSSGVSRGGSGFSASYNCQEPPSSHIQPGLCGLGNLGNTCFMNSALQCLSNTAPLTDYFLKDEYEAEINRDNPLGMKGEIAEAYAELIKQMWSGRDAHVAPRMFKTQVGRFAPQFSGYQQQDSQELLAFLLDGLHEDLNRVVAKEAWENHRLRNDSVIVDTFHGLFKSTLVCPECAKVSVTFDPFCYLTLPLPLKKDRVMEVFLVPADPHCRPTQYRVTVPLMGAVSDLCEALSRLSGIAAENMVVADVYNHRFHKIFQMDEGLNHIMPRDDIFVYEVCSTSVDGSECVTLPVYFRERKSRPSSTSSASALYGQPLLLSVPKHKLTLESLYQAVCDRISRYVKQPLPDEFGSSPLEPGACNGSRNSCEGEDEEEMEHQEEGKEQLSETEGSGEDEPGNDPSETTQKKIKGQPCPKRLFTFSLVNSYGTADINSLAADGKLLKLNSRSTLAMDWDSETRRLYYDEQESEAYEKHVSMLQPQKKKKTTVALRDCIELFTTMETLGEHDPWYCPNCKKHQQATKKFDLWSLPKILVVHLKRFSYNRYWRDKLDTVVEFPIRGLNMSEFVCNLSARPYVYDLIAVSNHYGAMGVGHY

SEQ ID NO: 38036 - protein, 313 aa, Homo sapiens
  ENSP00000400623
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKVSFFLPRLECNGAILAHCNFCLPGSSNSPASASRVAPSHLANFFFFEMESHSVTKLECGGAVSAYSRVQVMLLPQPPEWLG

SEQ ID NO: 38037 - protein, 363 aa, Homo sapiens
  ENSP00000408274
MAEGGGCRERPDAETQKSELGPLMRTTLQRGAQWYLIDSRWFKQWKKYVGFDSWDMYNVGEHNLFPGPIDNSGLFSDPESQTLKEHLIDELDYVLVPTEAWNKLLNWYGCVEGQQPIVRKVVEHGLFVKHCKVEVYLLELKLCENSDPTNVLSCHFSKADTIATIEKEMRKLFNIPAERETRLWNKYMSNTYEQLSKLDNTVQDAGLYQGQVLVIEPQNEDGTWPRQTLQSKGPQEMLTQQGMALQNYDNKLVKCIEELCQKQEELCWQIQQEEDKKQRLQNEVRQLTEKLACVNEKLARVNENLARKIASCSKFYQTIAETEATYLKMLESSQTLLSVLKREAGNLTKATASDQKSSGGRDS

SEQ ID NO: 38038 - protein, 1118 aa, Homo sapiens
  ENSP00000458963
MDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKNAVSKYGSQFQGNSQHDALEFLLWLLDRVHEDLEGSSRGPVSEKLPPEATKTSENCLSPSAQLPLGQSFVQSHFQAQYRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 38039 - protein, 1123 aa, Homo sapiens
  ENSP00000285199
MDLGPGDAAGGGPLAPRPRRRRSLRRLFSRFLLALGSRSRPGDSPPRPQPGHCDGDGEGGFACAPGPVPAAPGSPGEERPPGPQPQLQLPAGDGARPPGAQGLKNHGNTCFMNAVVQCLSNTDLLAEFLALGRYRAAPGRAEVTEQLAALVRALWTREYTPQLSAEFKNAVSKYGSQFQGNSQHDALEFLLWLLDRVHEDLEGSSRGPVSEKLPPEATKTSENCLSPSAQLPLGQSFVQSHFQAQYRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 38040 - protein, 910 aa, Homo sapiens
  ENSP00000459328
  MOD_RES (1)..(1): Any amino acid
XAIPSTTPWNSCSGCWIVYMRTWRVHPEGRCRRRSSLTCPHCLKQSNTFDPFLCVSLPIPLRQTRFLSVTLVFPSKSQRFLRVGLAVPILSTVAALRKMVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 38041 - protein, 648 aa, Homo sapiens
  ENSP00000477318
AACSGASRRSERRMPTVCGSSSRRISSTAVPWMNVFSSTPRRSRSRPGGPCPGREGGWLPLVGWPRAAGASQSGWFAFQLAQDDAWKCPHCQVLQQGMVKLSLWTLPDILIIHLKRFCQVGERRNKLSTLVKFPLSGLNMAPHVAQRSTSPEAGLGPWPSWKQPDCLPTSYPLDFLYDLYAVCNHHGNLQGGHYTAYCRNSLDGQWYSYDDSTVEPLREDEVNTRGAYILFYQKRNSIPPWSASSSMRGSTSSSLSDHWLLRLGSHAGSTRGSLLSWSSAPCPSLPQVPDSPIFTNSLCNQEKGGLEPRRLVRGVKGRSISMKAPTTSRAKQGPFKTMPLRWSFGSKEKPPGASVELVEYLESRRRPRSTSQSIVSLLTGTAGEDEKSASPRSNVALPANSEDGGRAIERGPAGVPCPSAQPNHCLAPGNSDGPNTARKLKENAGQDIKLPRKFDLPLTVMPSVEHEKPARPEGQKAMNWKESFQMGSKSSPPSPYMGFSGNSKDSRRGTSELDRPLQGTLTLLRSVFRKKENRRNERAEVSPQVPPVSLVSGGLSPAMDGQAPGSPPALRIPEGLARGLGSRLERDVWSAPSSLRLPRKASRAPRGSALGMSQRTVPGEQASYGTFQRVKYHTLSLGRKKTLPESSF

SEQ ID NO: 38042 - protein, 2555 aa, Homo sapiens
  ENSP00000342812
MTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEDELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFRGKHLSLIVRFPNQGRQVDELDIWSHTNDTIGSVRRCIVNRIKANVAHKKIELFVGGELIDSEDDRKLIGQLNLKDKSLITAKLTQINFNMPSSPDSSSDSSTASPGNHRNHYNDGPNLEVESCLPGVIMSVHPRYISFLWQVADLGSNLNMPPLRDGARVLMKLMPPDRTAVEKLRAVCLDHAKLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLVFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRYECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYILFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDWYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 38043 - protein, 237 aa, Homo sapiens
  ENSP00000406876
  MOD_RES (1)..(1): Any amino acid
XLLKTAVTQRIPSNYFAFALGRILSSHLLSSANFSGRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 38044 - protein, 1092 aa, Homo sapiens
  ENSP00000255304
MMDSPKIGNGLPVIGPGTDIGISSLHMVGYLGKNFDSAKVPSDEYCPACREKGKLKALKTYRISFQESIFLCEDLQCIYPLGSKSLNNLISPDLEECHTPHKPQKRKSLESSYKDSLLLANSKKTRNYIAIDGGKVLNSKHNGEVYDETSSNLPDSSGQQNPIRTADSLERNEILEADTVDMATTKDPATVDVSGTGRPSPQNEGCTSKLEMPLESKCTSFPQALCVQWKNAYALCWLDCILSALVHSEELKNTVTGLCSKEESIFWRLLTKYNQANTLLYTSQLSGVKDGDCKKLTSEIFAEIETCLNEVRDEIFISLQPQLRCTLGDMESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 38045 - protein, 763 aa, Homo sapiens
  ENSP00000480656
MESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSLTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIASESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 38046 - protein, 1347 aa, Homo sapiens
  ENSP00000328939
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38047 - protein, 1211 aa, Homo sapiens
  ENSP00000485539
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEALSLSSSS

SEQ ID NO: 38048 - protein, 1240 aa, Homo sapiens
  ENSP00000355420
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIK

SEQ ID NO: 38049 - protein, 1079 aa, Homo sapiens
  ENSP00000330446
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLRAGMQWCDLSSLQPPPPGFKRFSHLSLPNSWNYRHLPSCPTNFCIFVETGFHHVGQACLELLTSGGLLASASQSAGITGVSHHAR

SEQ ID NO: 38050 - protein, 207 aa, Homo sapiens
  ENSP00000372349
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAESKYF

SEQ ID NO: 38051 - protein, 1363 aa, Homo sapiens
  ENSP00000445274
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQAYLGHLTGFIQDNCNKGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38052 - protein, 1389 aa, Homo sapiens
  ENSP00000441943
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGSVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38053 - protein, 1392 aa, Homo sapiens
  ENSP00000372352
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38054 - protein, 1335 aa, Homo sapiens
  ENSP00000439922
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEALSLSSSS

SEQ ID NO: 38055 - protein, 1444 aa, Homo sapiens
  ENSP00000442047
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQAYRAHDPNTEHVLNHSQTPILQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38056 - protein, 1399 aa, Homo sapiens
  ENSP00000483735
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAYRAHDPNTEHVLNHSQTPILQQSLSLHMITSSQVEGLSSPAKKKRTSSPTKNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38057 - protein, 1264 aa, Homo sapiens
  ENSP00000484698
MKSCAVSLTTAAVAFGDEAKKMAEGKASRESEEESVSLTVEEREALGGMDSRLFGFVRLHEDGARTKTLLGKNAAFLYGLGLVYFYYNAFHWAIKAFQDVLYVDPSFCRAKEIHLRLGLMFKVNTDYKSSLKRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSENSGRRRKGPFKTIKFGTNIDLSDNKKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38058 - protein, 1367 aa, Homo sapiens
  ENSP00000485013
MKSCAVSLTTAAVAFGDEAKKMAEGKASRESEEESVSLTVEEREALGGMDSRLFGFVRLHEDGARTKTLLGKAVRCYESLILKAEGKVESDFFCQLGHFNLLLEDYSKALSAYQRYYSLQADYWKNAAFLYGLGLVYFYYNAFHWAIKAFQDVLYVDPSFCRAKEIHLRLGLMFKVNTDYKSSLKHFQLALIDCNPCTLSNAEIQFHIAHLYETQRKYHSAKEAYEQLLQTENLPAQVKATVLQQLGWMHHNMDLVGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNAARSKRCSNTSTLAARIKFLQAQLCNLPQSSLQNKTKLLPSIEEAWSLPIPAELTSRQGAMNTAQQNGSDNWNGGQSLSHHPVQQVYSLCLTPQKLQHLEQLRANRDNLNPAQKHQLEQLESQFVLMQQMRHKEVAQVRTTGIHNGAITDSSLPTNSVSNRQPHGALTRVSSVSQPGVRPACVEKLLSSGAFSAGCIPCGTSKILGSTDTILLGSNCIAGSESNGNVPYLQQNTHTLPHNHTDLNSSTEEPWRKQLSNSAQGLHKSQSSCLSGPNEEQPLFSTGSAQYHQATSTGIKKANEHLTLPSNSVPQGDADSHLSCHTATSGGQQGIMFTKESKPSKNRSLVPETSRHTGDTSNGCADVKGLSNHVHQLIADAVSSPNHGDSPNLLIADNPQLSALLIGKANGNVGTGTCDKVNNIHPAVHTKTDHSVASSPSSAISTATPSPKSTEQRSINSVTSLNSPHSGLHTVNGEGLGKSQSSTKVDLPLASHRSTSQILPSMSVSICPSSTEVLKACRNPGKNGLSNSCILLDKCPPPRPPTSPYPPLPKDKLNPPTPSIYLENKRDAFFPPLHQFCTNPKNPVTVIRGLAGALKLDLGLFSTKTLVEANNEHMVEVRTQLLQPADENWDPTGTKKIWRCESNRSHTTIAKYAQYQASSFQESLREENEKRTQHKDHSDNESTSSEKWKLQLHELTKLPAFARVVSAGNLLTHVGHTILGMNTVQLYMKVPGSRTPGHQENNNFCSVNINIGPGDCEWFVVPEDYWGVLNDFCEKNNLNFLMSSWWPNLEDLYEANVPVYRFIQRPGDLVWINAGTVHWVQAVGWCNNIAWNVGPLTACQYKLAVERYEWNKLKSVKSPVPMVHLSWNMARNIKVSDPKLFEMIKYCLLKILKQYQTLREALVAAGKEVIWHGRTNDEPAHYCSICEVEVFNLLFVTNESNTQKTYIVHCHDCARKTSKSLENFVVLEQYKMEDLIQVYDQFTLALSLSSSS

SEQ ID NO: 38059 - protein, 532 aa, Homo sapiens
  ENSP00000363229
MESAEPAGQARAAATKLSEAVGAALQEPRRQRRLVLVIVCVALLLDNMLYMVIVPIVPDYIAHMRGGGEGPTRTPEVWEPTLPLPTPANASAYTANTSASPTAAWPAGSALRPRYPTESEDVKIGVLFASKAILQLLVNPLSGPFIDRMSYDVPLLIGLGVMFASTVLFAFAEDYATLFAARSLQGLGSAFADTSGIAMIADKYPEEPERSRALGVALAFISFGSLVAPPFGGILYEFAGKRVPFLVLAAVSLFDALLLLAVAKPFSAAARARANLPVGTPIHRLMLDPYIAVVAGALTTCNIPLAFLEPTIATWMKHTMAASEWEMGMAWLPAFVPHVLGVYLTVRLAARYPHLQWLYGALGLAVIGASSCIVPACRSFAPLVVSLCGLCFGIALVDTALLPTLAFLVDVRHVSVYGSVYAIADISYSVAYALGPIVAGHIVHSLGFEQLSLGMGLANLLYAPVLLLLRNVGLLTRSRSERDVLLDEPPQGLYDAVRLRERPVSGQDGEPRSPPGPFDACEDDYNYYYTRS

SEQ ID NO: 38060 - protein, 116 aa, Homo sapiens
  ENSP00000383702
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRD

SEQ ID NO: 38061 - protein, 117 aa, Homo sapiens
  ENSP00000355122
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVSKYR

SEQ ID NO: 38062 - protein, 116 aa, Homo sapiens
  ENSP00000444181
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRG

SEQ ID NO: 38063 - protein, 118 aa, Homo sapiens
  ENSP00000379602
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVIYFFT

SEQ ID NO: 38064 - protein, 419 aa, Homo sapiens
  ENSP00000303129
MAKEGVEKAEETEQMIEKEAGKEPAEGGGGDGSHRLGDAQEMRAVVLAGFGGLNKLRLFRKAMPEPQDGELKIRVKACGLNFIDLMVRQGNIDNPPKTPLVPGFECSGIVEALGDSVKGYEIGDRVMAFVNYNAWAEVVCTPVEFVYKIPDDMSFSEAAAFPMNFVTAYVMLFEVANLREGMSVLVHSAGGGVGQAVAQLCSTVPNVTVFGTASTFKHEAIKDSVTHLFDRNADYVQEVKRISAEGVDIVLDCLCGDNTGKGLSLLKPLGTYILYGSSNMVTGETKSFFSFAKSWWQVEKVNPIKLYEENKVIAGFSLLNLLFKQGRAGLIRGVVEKLIGLYNQKKIKPVVDSLWALEEVKEAMQRIHDRGNIGKLILDVEKTPTPLMANDSTETSEAGEEEEDHEGDSENKERMPFIQ

SEQ ID NO: 38065 - protein, 839 aa, Homo sapiens
  ENSP00000385362
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPVFTPRVIGTAVARYNFAARDMRELSLREGDVVRIYSRIGGDQGWWKGETNGRIGWFPSTYVEEEGIQ

SEQ ID NO: 38066 - protein, 878 aa, Homo sapiens
  ENSP00000360916
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMIRYMQKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKSHGKMWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 38067 - protein, 868 aa, Homo sapiens
  ENSP00000360917
MEQWRQCGRWLIDCKVLPPNHRVVWPSAVVFDLAQALRDGVLLCQLLHNLSPGSIDLKDINFRPQMSQFLCLKNIRTFLKVCHDKFGLRNSELFDPFDLFDVRDFGKVISAVSRLSLHSIAQNKGIRPFPSEETTENDDDVYRSLEELADEHDLGEDIYDCVPCEDGGDDIYEDIIKVEVQQPMKMGMTEDDKRNCCLLEIQETEAKYYRTLEDIEKNYMSPLRLVLSPADMAAVFINLEDLIKVHHSFLRAIDVSVMVGGSTLAKVFLDFKERLLIYGEYCSHMEHAQNTLNQLLASREDFRQKVEECTLKVQDGKFKLQDLLVVPMQRVLKYHLLLKELLSHSAERPERQQLKEALEAMQDLAMYINEVKRDKETLRKISEFQSSIENLQVKLEEFGRPKIDGELKVRSIVNHTKQDRYLFLFDKVVIVCKRKGYSYELKEIIELLFHKMTDDPMNNKDVKKWSYGFYLIHLQGKQGFQFFCKTEDMKRKWMEQFEMAMSNIKPDKANANHHSFQMYTFDKTTNCKACKMFLRGTFYQGYMCTKCGVGAHKECLEVIPPCKFTSPADLDASGAGPGPKMVAMQNYHGNPAPPGKPVLTFQTGDVLELLRGDPESPWWEGRLVQTRKSGYFPSSSVKPCPVDGRPPISRPPSREIDYTAYPWFAGNMERQQTDNLLKSHASGTYLIRERPAEAERFAISIKFNDEVKHIKVVEKDNWIHITEAKKFDSLLELVEYYQCHSLKESFKQLDTTLKYPYKSRERSASRASSRSPASCASYNFSFLSPQGLSFASQGPSAPFWSVFTPRVIGTAVARYNFAARDMRELSLREGDVVRIYSRIGGDQGWWKGETNGRIGWFPSTYVEEEGIQ

SEQ ID NO: 38068 - protein, 290 aa, Homo sapiens
  ENSP00000234392
MGDGGAERDRGPARRAESGGGGGRCGDRSGAGDLRADGGGHSPTEVAGTSASSPAGSRESGADSDGQPGPGEADHCRRILVRDAKGTIREIVLPKGLDLDRPKRTRTSFTAEQLYRLEMEFQRCQYVVGRERTELARQLNLSETQVKVWFQNRRTKQKKDQSRDLEKRASSSASEAFATSNILRLLEQGRLLSVPRAPSLLALTPSLPGLPASHRGTSLGDPRNSSPRLNPLSSASASPPLPPPLPAVCFSSAPLLDLPAGYELGSSAFEPYSWLERKVGSASSCKKANT

SEQ ID NO: 38069 - protein, 3396 aa, Homo sapiens
  ENSP00000265077
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 38070 - protein, 1594 aa, Homo sapiens
  ENSP00000425959
MPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 38071 - protein, 1240 aa, Homo sapiens
  ENSP00000426251
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPI

SEQ ID NO: 38072 - protein, 354 aa, Homo sapiens
  ENSP00000426715
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRKCLIPF

SEQ ID NO: 38073 - protein, 655 aa, Homo sapiens
  ENSP00000421362
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 38074 - protein, 1642 aa, Homo sapiens
  ENSP00000342768
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 38075 - protein, 2409 aa, Homo sapiens
  ENSP00000340062
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 38076 - protein, 290 aa, Homo sapiens
  ENSP00000273038
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 38077 - protein, 231 aa, Homo sapiens
  ENSP00000404624
MEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 38078 - protein, 210 aa, Homo sapiens
  ENSP00000416615
MIKVRNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 38079 - protein, 206 aa, Homo sapiens
  ENSP00000402878
MNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 38080 - protein, 296 aa, Homo sapiens
  ENSP00000404251
MLFMKMDLLNYQYLDKMNNNIGILCYEGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 38081 - protein, 295 aa, Homo sapiens
  ENSP00000413030
MTENTHFDKIPESCALKSWRHPGLHHGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKEPEPAPNSVSITGSVDDHFAKALGDTWLQIKAAKDGASSSPESASRRGQPASPSAHMVSHSHSPSVVS

SEQ ID NO: 38082 - protein, 223 aa, Homo sapiens
  ENSP00000412923
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPSAATTCDPVVEEHFRRSLGKNYKE

SEQ ID NO: 38083 - protein, 200 aa, Homo sapiens
  ENSP00000394439
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPASYRRPPS

SEQ ID NO: 38084 - protein, 190 aa, Homo sapiens
  ENSP00000394123
MKDLKKRVALGYISTHTGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQNRPSVITCASAGARNCNLSHCPIAHSGCAAPGPAS

SEQ ID NO: 38085 - protein, 169 aa, Homo sapiens
  ENSP00000391932
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDASRPAGLSPTLTPGERQQVGLCLGGWRG

SEQ ID NO: 38086 - protein, 147 aa, Homo sapiens
  ENSP00000411670
MTENTHFDKIPESCALKSWRHPGLHHGEAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSLGLEQPLALTKNSLDA

SEQ ID NO: 38087 - protein, 81 aa, Homo sapiens
  ENSP00000391554
MEPGDEDLDCDNDHVSKMSRIFNPHLNKTANGDCRRDPRERSRSPIERAVAPTMSLHGSHLYTSLPSLGLEQPLALTKNSL

SEQ ID NO: 38088 - protein, 127 aa, Homo sapiens
  ENSP00000395557
METPLDVLSRAASLVHADDEKREAALRGEPRIQTLPVASALSSHRTGPPPISPSKRKFSMEPGDEDLDCDNDHVSKMSRIFNPHLNKTANGDCRRDPRERSRSPIERAVAPTMSLHGSHLYTSLPSL

SEQ ID NO: 38089 - protein, 60 aa, Homo sapiens
  ENSP00000393100
MEPGDEDLDCDNDHVSKMSRIFNPHLNKTANGDCRRDPRERSRSPIERAVAPTMSLHGSH

SEQ ID NO: 38090 - protein, 59 aa, Homo sapiens
  ENSP00000485472
METPLDVLSRAASLVHADDEKREAALRGEPRIQTLPVASALSSHRTGPPPISPSKRKFS

SEQ ID NO: 38091 - protein, 31 aa, Homo sapiens
  ENSP00000492281
METPLDVLSRAASLVHADDEKRSCCVAQAGF

SEQ ID NO: 38092 - protein, 466 aa, Homo sapiens
  ENSP00000446007
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 38093 - protein, 149 aa, Homo sapiens
  ENSP00000489830
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDL

SEQ ID NO: 38094 - protein, 109 aa, Homo sapiens
  ENSP00000490509
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQE

SEQ ID NO: 38095 - protein, 466 aa, Homo sapiens; identical to SEQ ID NO: 38092
  ENSP00000224237

SEQ ID NO: 38096 - protein, 431 aa, Homo sapiens
  ENSP00000435613
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRGKHFISL

SEQ ID NO: 38097 - protein, 228 aa, Homo sapiens
  ENSP00000431702
MRNCFRLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESR

SEQ ID NO: 38098 - protein, 170 aa, Homo sapiens
  ENSP00000356213
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSSEGESPDFPEELEK

SEQ ID NO: 38099 - protein, 169 aa, Homo sapiens
  ENSP00000356212
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSNISEDPVPVKRHSDAVFTDNYTRLRKQMAVKKYLNSILNGKRSSEGESPDFPEELEK

SEQ ID NO: 38100 - protein, 119 aa, Homo sapiens
  ENSP00000410356
  MOD_RES (1)..(1): Any amino acid
XVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSEGESPDFPEELEK

SEQ ID NO: 38101 - protein, 438 aa, Homo sapiens
  ENSP00000262178
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 38102 - protein, 422 aa, Homo sapiens
  ENSP00000366860
MPLWEAPSDHPANPPATLQGHTSLPGCQEEPARDPQSGLPQITSESSSFSEGSLPSWSSGPAGAKLNASHEGIGSSSDGNGDSKAATERVVSAMDTVRRKHPEITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 38103 - protein, 579 aa, Homo sapiens
  ENSP00000384497
MRTLLPPALLTCWLLAPVSAPATPAPRRLGPGSPLPRRALLPPVFAFLPGAGARAGSGRGSGVARGPELPPGEREALSSGPAGLRDSGWEAACALPRAPPSGVCWKRDRFFLDASTMSSFGAVPGAGSCGRLRGLRVSRGDRGWRWPQMPLGPSLYLLVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 38104 - protein, 77 aa, Homo sapiens
  ENSP00000402690
MRTLLPPALLTCWLLAPVNSIHPECRFHLEIQEEETKCAELLRSQTEKHKGHTKGFILIHAGGLKRILDPHTYPLAP

SEQ ID NO: 38105 - protein, 693 aa, Homo sapiens
  ENSP00000368544
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGEMDSWKPGSVLLDEGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 38106 - protein, 203 aa, Homo sapiens
  ENSP00000393561
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGKCSRVIESKPSESMNTRRVLGDSGEINILTGQAPLALAIF

SEQ ID NO: 38107 - protein, 347 aa, Homo sapiens
  ENSP00000417874
MGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 38108 - protein, 630 aa, Homo sapiens
  ENSP00000384154
MRTVVLTMKASVIEMFLAVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMGEMDSWKPGSVLLDEGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 38109 - protein, 656 aa, Homo sapiens
  ENSP00000368543
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 38110 - protein, 657 aa, Homo sapiens
  ENSP00000385658
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLDCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 38111 - protein, 134 aa, Homo sapiens
  ENSP00000419251
  MOD_RES (1)..(1): Any amino acid
XTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGPLHWYWKNSPGNGEEWVGRETAPISQLST

SEQ ID NO: 38112 - protein, 678 aa, Homo sapiens
  ENSP00000374625
MRTVVLTMKASVIEMFLVLLVTGVHSNKETAKKIKRPKFTVPQINCDVKAGKIIDPEFIVKCPAGCQDPKYHVYGTDVYASYSSVCGAAVHSGVLDNSGGKILVRKVAGQSGYKGSYSNGVQSLSLPRWRESFIVLESKPKKGVTYPSALTYSSSKSPAAQAGETTKAYQRPPIPGTTAQPVTLMQLLAVTVAVATPTTLPRPSPSAASTTSIPRPQSVGHRSQEMDLWSTATYTSSQNRPRADPGIQRQDPSGAAFQKPVGADVSLGLVPKEELSTQSLEPVSLGDPNCKIDLSFLIDGSTSIGKRRFRIQKQLLADVAQALDIGPAGPLMGVVQYGDNPATHFNLKTHTNSRDLKTAIEKITQRGGLSNVGRAISFVTKNFFSKANGNRSGAPNVVVVMVDGWPTDKVEEASRLARESGINIFFITIEGAAENEKQYVVEPNFANKAVCRTNGFYSLHVQSWFGLHKTLQPLVKRVCDTDRLACSKTCLNSADIGFVIDGSSSVGTGNFRTVLQFVTNLTKEFEISDTDTRIGAVQYTYEQRLEFGFDKYSSKPDILNAIKRVGYWSGGTSTGAAINFALEQLFKKSKPNKRKLMILITDGRSYDDVRIPAMAAHLKGVITYAIGVAWAAQEELEVIATHPARDHSFFVDEFDNLHQYVPRIIQNICTEFNSQPRN

SEQ ID NO: 38113 - protein, 406 aa, Homo sapiens
  ENSP00000262291
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 38114 - protein, 74 aa, Homo sapiens
  ENSP00000465972
MAENGKNCDQRRVAMNKEHHNGNFTDPSSVNEKKRREREERQNIVLWRQPLITLQYFSLEILVILKEWTSKVHI

SEQ ID NO: 38115 - protein, 44 aa, Homo sapiens
  ENSP00000466579
MAENGKNCDQRRVAMNKEHHNGNFTDYGIVKALWCLFYCCLLCL

SEQ ID NO: 38116 - protein, 75 aa, Homo sapiens
  ENSP00000465947
MAENGKNCDQRRVAMNKEHHNGNFTDPSSVNEKKRREREERQNIVLWRQPLITLQYFSLEILVILKEWTSNMCNV

SEQ ID NO: 38117 - protein, 44 aa, Homo sapiens
  ENSP00000466413
MWGIGTAIGELPPYFMARAARLSGAEPDDEEYQEFEEMLEHAES

SEQ ID NO: 38118 - protein, 167 aa, Homo sapiens
  ENSP00000466198
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLIICPDEEGTEGTISLWSIISKVRIEACMW

SEQ ID NO: 38119 - protein, 78 aa, Homo sapiens
  ENSP00000467093
MAENGKNCDQRRVAMNKEHHNGNFTDPSSVNEKKRREREERQNIVLWRQPLITLQYFSLEILVILKEWTSKLWHRQSI

SEQ ID NO: 38120 - protein, 138 aa, Homo sapiens
  ENSP00000466511
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYL

SEQ ID NO: 38121 - protein, 92 aa, Homo sapiens
  ENSP00000465397
MAENGKNCDQRRVAMNKEHHNGNFTDPSSVNEKKRREREERQNIVLWRQPLITLQYFSLEILVILKEWTSKLWHRQSIVVSFLLLLAVLIAT

SEQ ID NO: 38122 - protein, 58 aa, Homo sapiens
  ENSP00000465911
  MOD_RES (1)..(1): Any amino acid
XPSSVNEKKRREREERQNIVLWRQPLITLQYFSLEILVILKEWTSKTLPPGPNWQFKN

SEQ ID NO: 38123 - protein, 225 aa, Homo sapiens
  ENSP00000467350
GIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGLEDNGALQPPPPSAVPGIGPSLQKPFQEYLEAQRQKLHHKSEMGTPQGENWLSWMFEKLVVVMVCYFILSIINSMAQSYAKRIQQRLNSEEKTK

SEQ ID NO: 38124 - protein, 285 aa, Homo sapiens
  ENSP00000267202
MAGAGSEARFAGLSLVQLNELLEDEGQLTEMVQKMEETQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPPRLPPHQPGFILQ

SEQ ID NO: 38125 - protein, 271 aa, Homo sapiens
  ENSP00000446075
MAGAGSEARFAGLSLVQLNELLEDEGQLTEMVQKMEENVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPTAPLPYPAPEASGPPAVAPRRIPPPPPPVPAGRLATPFTAAMSSGQAVPYPGLQCPPLPPRVGLPTQQGFSSQFVSPYPPPLPQRPPP

SEQ ID NO: 38126 - protein, 184 aa, Homo sapiens
  ENSP00000360294
MQSGCVLELRNAGLVACLALITVFVAECCYGDSCQTQNVQLNKEMTLASNRSLAEGNLLYQPQLDTLKARLTQKYQELQVLFEAYQIKKTKLDRQSSSASLETLLALLQAEGAKIEEDTENMAEKFLDGELPLDSFIDVYQSKRKLAHMRRVKIEKLQEMVLKGQRLPQALAPLPPRLPELAPT

SEQ ID NO: 38127 - protein, 327 aa, Homo sapiens
  ENSP00000318684
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 38128 - protein, 284 aa, Homo sapiens
  ENSP00000385013
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLR

SEQ ID NO: 38129 - protein, 414 aa, Homo sapiens
  ENSP00000357080
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 38130 - protein, 191 aa, Homo sapiens
  ENSP00000384014
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITRVEMLEIIEAIYKMVGTVIMMKMNEDGLTPEQRVDKIFSKMDKNKDDQITLDEFKEAAKSDPSIVLLLQCDIQK

SEQ ID NO: 38131 - protein, 118 aa, Homo sapiens
  ENSP00000405511
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITR

SEQ ID NO: 38132 - protein, 191 aa, Homo sapiens; identical to SEQ ID NO: 38130
  ENSP00000295156

SEQ ID NO: 38133 - protein, 104 aa, Homo sapiens
  ENSP00000390124
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWA

SEQ ID NO: 38134 - protein, 191 aa, Homo sapiens; identical to SEQ ID NO: 38130
  ENSP00000384719

SEQ ID NO: 38135 - protein, 285 aa, Homo sapiens
  ENSP00000335038
MEQRNRLGALGYLPPLLLHALLLFVADAAFTEVPKDVTVREGDDIEMPCAFRASGATSYSLEIQWWYLKEPPRELLHELALSVPGARSKVTNKDATKISTVRVQGNDISHRLRLSAVRLQDEGVYECRVSDYSDDDTQEHKAQAMLRVLSRFAPPNMQAAEAVSHIQSSGPRRHGPASAANANNAGAASRTTSEPGRGDKSPPPGSPPAAIDPAVPEAAAASAAHTPTTTVAAAAAASSASPPSGQAVLLRQRHGSGTGRSYTTDPLLSLLLLALHKFLRLLLGH

SEQ ID NO: 38136 - protein, 478 aa, Homo sapiens
  ENSP00000226218
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 38137 - protein, 118 aa, Homo sapiens
  ENSP00000440439
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKP

SEQ ID NO: 38138 - protein, 786 aa, Homo sapiens
  ENSP00000407726
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHRCFSFGIGEGTSTSLIKGIARASGGTSEFITGKDRMQSKALRTLKRSLQPVVEDVSLSWHLPPGLSAKMLSPEQTVIFRGQRLISYAQLTGRMPAAETTGEVCLKYTLQGKTFEDKVTFPLQPKPDVNLTIHRLAAKSLLQTKDMGLRETPASDKKDALNLSLESGVISSFTAFIAINKELNKPVQGPLAHRDVPRPILLGASAPLKIKCQSGFRKALHSDRPPSASQPRGELMCYKAKTFQMDDYSLCGLISHKDQHSPGFGENHLVQLIYHQNANGSWDLNEDLAKILGMSLEEIMAAQPAELVDSSGWATILAVIWLHSNGKDLKCEWELLERKAVAWMRAHAGSTMPSVVKAAITFLKSSVDPAIFAF

SEQ ID NO: 38139 - protein, 415 aa, Homo sapiens
  ENSP00000355070
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHR

SEQ ID NO: 38140 - protein, 415 aa, Homo sapiens; identical to SEQ ID NO: 38139
  ENSP00000404683

SEQ ID NO: 38141 - protein, 431 aa, Homo sapiens
  ENSP00000376501
MSSVCDMSFLQKSCITMVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHR

SEQ ID NO: 38142 - protein, 786 aa, Homo sapiens; identical to SEQ ID NO: 38138
  ENSP00000376504

SEQ ID NO: 38143 - protein, 1242 aa, Homo sapiens
  ENSP00000398688
MPGLYCPSSWTPLPLTDSWVRACANGPCLSVRARLTYRNPQPQPVDGVFVYPLAEAEVVSGFEAEAAGRRVSFQLQSRRRSQAACCRALGPGLGTPTPRRCAQGHLVLDLAQARSTLVLPTGIIAAAGTMTVTLHSSRELPSRPDGVLHVALPTVLTPLAPPGPPGPPRPPGLCDDSPTSCFGVGSLQEEGLAWEELAAPRDVFSGPARCPAPYTFSFEMLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQSTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 38144 - protein, 1024 aa, Homo sapiens
  ENSP00000273794
MLVTGPCLLAGLESPSHALRADAPPHASSAATICVTLAEGHHCDRALEILLHPSEPHQPHLMLEGGSLSSAEYEARVRARRDFQRLQRRDSDGDRQVWFLQRRFHKDILLNPVLALSFCPDLSSKPGHLGTATRELLFLLDSSSVAHKDAIVLAVKSLPPQTLINLAVFGTLVQPLFPESRPCSDDAVQLICESIETLQVPSGPPDVLAALDWAVGQPQHRAYPRQLFLLTAASPMAATTHRTLELMRWHRGTARCFSFGLGPTCHQLLQGLSALSRGQAYFLRPGQRLQPMLVQALRKALEPALSDISVDWFVPDTVEALLTPREIPALYPGDQLLGYCSLFRVDGFRSRPPGGQEPGWQSSGGSVFPSPEEAPSAASPGTEPTGTSEPLGTGTVSAELSSPWAARDSEQTGTDALTDPVTDPGPNPSDTAIWRRIFQSSYIREQYVLTHCSASPEPGPGSTGSSESPGSQGPGSPEGSAPLEPPSQQGCRSLAWGEPAGSRSCPLPAPTPAPFKVGALSTEVLGRQHRAALAGRSLSSPPGRANQVPGRPRKPSLGAILDGPSPEPGQQLGQGLDDSGNLLSPAPMDWDMLMEPPFLFTAVPPSGELAPPAVPPQAPRCHVVIRGLCGEQPMCWEVGVGLETLWGPGDGSQPPSPPVREAAWDQALHRLTAASVVRDNEQLALRGGAETTADRGHARRCWLRALQTSKVSSAPSCFTCPVAVDATTREVLPGALQVCSSEPAEPPGTPPASHSHLDAAPLPTVVYSKGLQRGSPAGAWDSDQNGNSKRALGDPATPTEGPRRPPPRPPCRLSMGRRHKLCSPDPGQANNSEGSDHDYLPLVRLQEAPGSFRLDAPFCAAVRISQERLCRASPFAVHRASLSPTSASLPWALLGPGVGQGDSATASCSPSPSSGSEGPGQVDSGRGSDTEASEGAEGLGGTDLRGRTWATAVALAWLEHRCAAAFDEWELTAAKADCWLRAQHLPDGLDLAALKAAARGLFLLLRHWDQNLQLHLLCYSPANV

SEQ ID NO: 38145 - protein, 325 aa, Homo sapiens
  ENSP00000341819
MPSSTAMAVGALSSSLLVTCCLMVALCSPSIPLEKLAQAPEQPGQEKREHASRDGPGRVNELGRPARDEGGSGRDWKSKSGRGLAGREPWSKLKQAWVSQGGGAKAGDLQVRPRGDTPQAEALAAAAQDAIGPELAPTPEPPEEYVYPDYRGKGCVDESGFVYAIGEKFAPGPSACPCLCTEEGPLCAQPECPRLHPRCIHVDTSQCCPQCKERKNYCEFRGKTYQTLEEFVVSPCERCRCEANGEVLCTVSACPQTECVDPVYEPDQCCPICKNGPNCFAETAVIPAGREVKTDECTICHCTYEEGTWRIERQAMCTRHECRQM

SEQ ID NO: 38146 - protein, 598 aa, Homo sapiens
  ENSP00000329654
MASLRRVKVLLVLNLIAVAGFVLFLAKCRPIAVRSGDAFHEIRPRAEVANLSAHSASPIQDAVLKRLSLLEDIVYRQLNGLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKRYPGLVKVVRNQKREGLIRARIEGWKVATGQVTGFFDAHVEFTAGWAEPVLSRIQENRKRVILPSIDNIKQDNFEVQRYENSAHGYSWELWCMYISPPKDWWDAGDPSLPIRTPAMIGCSFVVNRKFFGEIGLLDPGMDVYGGENIELGIKVWLCGGSMEVLPCSRVAHIERKKKPYNSNIGFYTKRNALRVAEVWMDDYKSHVYIAWNLPLENPGIDIGDVSERRALRKSLKCKNFQWYLDHVYPEMRRYNNTVAYGELRNNKAKDVCLDQGPLENHTAILYPCHGWGPQLARYTKEGFLHLGALGTTTLLPDTRCLVDNSKSRLPQLLDCDKVKSSLYKRWNFIQNGAIMNKGTGRCLEVENRGLAGIDLILRSCTGQRWTIKNSIK

SEQ ID NO: 38147 - protein, 188 aa, Homo sapiens
  ENSP00000392019
LLDFKTKTTPPLGVLADTERGLSVFPPVSLSATAEMADLFRITDWGMFMSLDRITNGGLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKR

SEQ ID NO: 38148 - protein, 519 aa, Homo sapiens
  ENSP00000479090
GLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKRYPGLVKVVRNQKREGLIRARIEGWKVATGQVTGFFDAHVEFTAGWAEPVLSRIQENRKRVILPSIDNIKQDNFEVQRYENSAHGYSWELWCMYISPPKDWWDAGDPSLPIRTPAMIGCSFVVNRKFFGEIGLLDPGMDVYGGENIELGIKVWLCGGSMEVLPCSRVAHIERKKKPYNSNIGFYTKRNALRVAEVWMDDYKSHVYIAWNLPLENPGIDIGDVSERRALRKSLKCKNFQWYLDHVYPEMRRYNNTVAYGELRNNKAKDVCLDQGPLENHTAILYPCHGWGPQLARYTKEGFLHLGALGTTTLLPDTRCLVDNSKSRLPQLLDCDKVKSSLYKRWNFIQNGAIMNKGTGRCLEVENRGLAGIDLILRSCTGQRWTIKNSIK

SEQ ID NO: 38149 - protein, 265 aa, Homo sapiens
  ENSP00000316775
MEALPPVRSSLLGILLQVTRLSVLLVQNRDHLYNFLLLKINLFNHWVSGLAQEARGSCNWQAHLPLGAAACPLGQALWAGLALIQVPVWLVLQGPRLMWAGMWGSTKGLGLALLSAWEQLGLSVAIWTDLFLSCLHGLMLVALLLVVVTWRVCQKSHCFRLGRQLSKALQVNCVVRKLLVQLRRLYWWVETMTALTSWHLAYLITWTTCLASHLLQAAFEHTTQLAEAQEVEPQEVSGSSLLPSLSASSDSESGTVLPEQETPRE

SEQ ID NO: 38150 - protein, 60 aa, Homo sapiens
  ENSP00000403621
MEALPPVRSSLLGILLQVTRLSVLRQGLALSPSLERSGAGSARCSLQLPVSSNPPPSASK

SEQ ID NO: 38151 - protein, 1283 aa, Homo sapiens
  ENSP00000422763
MSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVWNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 38152 - protein, 1322 aa, Homo sapiens
  ENSP00000280190
MAWMTYISNWFEQDDWYEGLQRANMSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYSVPFCYVNRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 38153 - protein, 1297 aa, Homo sapiens
  ENSP00000422200
MAWMTYISNWFEQDDWYEGLQRANMSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 38154 - protein, 101 aa, Homo sapiens
  ENSP00000427502
MAWMTYISNWFEQDDWYEGLQRANMSQVRQVGLLAAGCQPWNKDVCAASGDRFAYCATLAIYIYQGSLLLLVGAGMQRMWWHLFPTEAHCSFGPSQDQIVE

SEQ ID NO: 38155 - protein, 226 aa, Homo sapiens
  ENSP00000426847
  MOD_RES (1)..(1): Any amino acid
XIPASLSWCWNAEDVVAFVSHRGPLFIWTISGPDSGVIVHKDAHSFLSDICMFRWHTHQKGKVVFGHIDGSLSIFHPVSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNE

SEQ ID NO: 38156 - protein, 557 aa, Homo sapiens
  ENSP00000426985
  MOD_RES (1)..(1): Any amino acid
XWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 38157 - protein, 344 aa, Homo sapiens
  ENSP00000376139
MNLLPCNPHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGTLIRIFDTSSGHLIQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 38158 - protein, 201 aa, Homo sapiens
  ENSP00000461488
  MOD_RES (1)..(1): Any amino acid
XHGNGLLYAGFNQDHGCFACGMENGFRVYNTDPLKEKEKQEFLEGGVGHVEMLFRCNYLALVGGGKKPKYPPNKVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGI

SEQ ID NO: 38159 - protein, 124 aa, Homo sapiens
  ENSP00000460297
  MOD_RES (1)..(1): Any amino acid
XQELRRGSQAANIYCINFNQDASLICVSSDHGTVHIFAAEDPKRNKQSSLASASFLPKYFSSKWSFSKFQVPSGSPCICAFGTEPNAVIAICADGSYYKFLFNPKGECIRDVYAQFLEMTDDKL

SEQ ID NO: 38160 - protein, 174 aa, Homo sapiens
  ENSP00000458738
MNLLPCNPHGNGLLYAGFNQDHGCFACGMENGFRVYNTDPLKEKEKQVMIWDDLKKKTVIEIEFSTEVKAVKLRRDRIVVVLDSMIKVFTFTHNPHQLHVFETCYNPKGLCVLCPNSNNSLLAFPGTHTGHVQLVDLASTEKPPVDIPAHEGVLSCIALNLQGTRIATASEKGI

SEQ ID NO: 38161 - protein, 85 aa, Homo sapiens
  ENSP00000461355
MNLLPCNPHGNGLLYAGFNQDHGCFACGMENGFRVYNTDPLKEKEKQEFLEGGVGHVEMLFRCNYLALVGGGKKPKYPPNKGTEK

SEQ ID NO: 38162 - protein, 697 aa, Homo sapiens
  ENSP00000311343
MAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQVISSDTGSTVSFWMIDTGQKIKQFTGCHGNAEISTMALDANETRLLTGSTDGTVKIWDFNGYCHHTLNVGQDGAVDISQILILKKKILVTGWERAITVFRPQNFNQFFIQPEEWKGGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFLKARKNTAVTGGANLVSCGGSGYVRFWDIYKKQLLAEFLAHSGVGSIIMSTDKMNRYLTTGDLDGWLKIWNIEEYCLNSSKNKITKAPTLIRSFQPHEDRISSLEMCEPGGQLLIISSSADCSICVTGVCNAPVWIFGQAKHWHIENCLFLPKRDTNLVESEIQKEISLFSKEESCLDPTEHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 38163 - protein, 674 aa, Homo sapiens
  ENSP00000419130
  MOD_RES (1)..(1): Any amino acid
XPASACEDGEATMTINWAELLSGCHKCCHILEHKLHQGDWVRQVTYNASLDAIISSTTSNTNSVVMAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQVISSDTGSTVSFWMIDTGQKIKQFTGCHGNAEISTMALDANETRLLTGSTDGTVKIWDFNGYCHHTLNVGQDGAVDISQILILKKKILVTGWERYDYASWKTIGRAITVFRPQNFNQFFIQPEEWKGGIQHHDDILCAAFLPPQTLVTGSYDGEIVLWNNSTENAHHVLHPDYQRLLKSKLDTKPQKLLSAGRSQPSHPMADHSTTGVRNFEIDTEGKNAVMRLCFLKARKNTAVTGGANLVSCGGSGYVRFWDIYKKQLLAEFLAHSGVGSIIMSTDKMNRYLTTGDLDGWLKIWNIEEESCLDPTEHSLLNKKNKDDSTYNVRPSEDINLDIKYKERSTCMKETQKPYYGEVIKKSFSTFRSLNIGALEELPEVNKPAFLLDPEKYFRKEPEEERPQILEAPSLFKTLKAVFDEKNLFPKEILHHERKAKQLCQEKSCEVKKNKK

SEQ ID NO: 38164 - protein, 518 aa, Homo sapiens
  ENSP00000419749
MSCQKAVLELNIGSQLGPKSPERTEGVTAFEDYGTGLLENQLSVGDFVKIQKAFESPQPRKIICMSREDFTQKMTEIVGWGTKEEYGELFDKVDVAQDGFINWDKLTSFILLELYEQDERAKATVVPQWKDLEFLPVKHKDTIQKVIFLKNSSHYLTISKEGLLAIWGEHLKLQETFPITSDATKLKHLWVTSLVSLENVNKIAVAFTSKEVCFYDLLSKEEFACQYKLQGLKGTPICMDYWYDPLDANESILSFGDITGKVQAIAFTAALISLFERPASACEDGEATMTINWAELLSGCHKCCHILEHKLHQGDWVRQVTYNASLDAIISSTTSNTNSVVMAWREKSKKRLNMTSFNIAQGIHAFDYHSRLNLIATAGINNKVCLWNPYVVSKPVGVLWGHSASVIAVQFFVERKQLFSFSKDKVLRLWDIQHQLSIQRIACSFPKSQDFRCLFHFDEAHGRLFISFNNQLALLAMKSEASKRVKSHEKAVTCVLYNSILKQPSQCEDDTNEDPYDN

SEQ ID NO: 38165 - protein, 139 aa, Homo sapiens
  ENSP00000418539
  MOD_RES (1)..(1): Any amino acid
XIDTEGKNAVMRLCFLKARKNTAVTGGANLVSCGGSGYVRFWDIYKKQLLAEFLAHSGVGSIIMSTDKMNRYLTTGDLDGWLKIWNIEAKHWHIENCLFLPKRDTNLVESEIQKEISLFSKEESCLDPTEHSLLNKKNK

SEQ ID NO: 38166 - protein, 61 aa, Homo sapiens
  ENSP00000417090
MSCQKAVLELNIGSQLGPKSPERTEGVTAFEDYGTGLLENQLSVGDFVKIQKAFELLTMHL

SEQ ID NO: 38167 - protein, 118 aa, Homo sapiens
  ENSP00000418718
MSCQKAVLELNIGSQLGPKSPERTEGVTAFEDYGTGLLENQLSVGDFVKIQKAFEVISSDTGSTVSFWMIDTGQKIKQFTGCHGNAEISTMALDANETRLLTGSTDGTVKIWDFNGYC

SEQ ID NO: 38168 - protein, 113 aa, Homo sapiens
  ENSP00000419917
MSCQKAVLELNIGSQLGPKSPERTEGVTAFEDYGTGLLENQLSVGDFVKIQKAFEIAVAFTSKEVCFYDLLSKEEFACQYKLQGLKGTPICMDYWYDPLDANESILSFGDITG

SEQ ID NO: 38169 - protein, 1149 aa, Homo sapiens
  ENSP00000288912
MSDAAEAPREATGENGETEMKEEEEPNPNYKEVEDPQQESKDDTIAWRESQEEERKTGEEEGEEEGKEDKKIVMEETEEKAGEVQEKEASGIQEETTVEPQEVTASMIRLETQITDSQSITSGIFPKTQRGSKSKLSLQLEDAETDELLRDLSTQIEFLDLDQISPEEQQISSPERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWYEERDTLAHSAPLLTEKTFNKLVGKFSQSIFHLNLTQILSATMEGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKVGLQILPVDGNPHKTSAIVCHPNGVAGMAVSYDGCYAFTAGGHDRSVVQWKITLSVLEAAVSLGGEDLTPFYGLLSGGREGKFYRELEDYFYYSQLRSQGIDTMETRKVSEHICLSELPFVMRAIGFYPSEEKIDDIFNEIKFGEYVDTGKLIDKINLPDFLKVYLNHKPPFGNTMSGIHKSFEVLGYTNSKGKKAIRREDFLRLLVTKGEHMTEEEMLDCFASLFGLNPEGWKSEPATCSVKGSEICLEEELPDEITAEIFATEILGLTISEDSGQDGQ

SEQ ID NO: 38170 - protein, 941 aa, Homo sapiens
  ENSP00000380595
MSDAAEAPREATGENGETEMKEEEEPNPNYKEVEDPQQESKDDTIAWRESQEEERKTGEEEGEEEGKEDKKIVMEETEEKAGEVQEKEASGIQEETTVEPQEVTASMIRLETQITDSQSITSGIFPKTQRGSKSKLSLQLEDAETDELLRDLSTQIEFLDLDQISPEEQQISSPERQPSGELEEKTDRMPQDELGQERRDLEPENREEGQERRVSDIQSKAGISRESLVSSTTEDILFQKDKSTPVYPLTMTWSFGWNSSLPVYYIREERQRVLLYVCAHTAIIYNVFRNNQYHLQGHANIISCLCVSEDRRWIATADKGPDCLVIIWDSFTGIPVHTIFDSCPEGNGIMAMAMTHDAKYLATISDAEVQKVCIWKWTLAVETPACTLELPTEYGVQNYVTFNPTNNKELVSNSKTRAIYYAWYEERDTLAHSAPLLTEKTFNKLVGKFSQSIFHLNLTQILSATMEGKLVVWDIHRPPSSASTFLGFPYIKPCKLVHLQKEGITVLTTIDSYIVTGDIKGNIKFYDHTLSIVNWYSHLKLGAIRTLSFSKTPATPPTEKSNYPPDCTLKGDLFVLRNFIIGTSDAAVYHLTTDGTKLEKLFVEPKDAICAISCHPYQPLIAIGSICGMIKVWNYENKQYLFSRVFEKGLGVQSLTYNPEGALLGAGFTEGTVYILDAMSLENESPEPFKYSRTSVTHISFSHDSQYMATADRSFTVAVYMLVVRNGQRVWEYLARLRSHRKSIRSLLFGVYLDSNEPRLLSLGTDRLLIEYDLLRSYKDHLEVLDIHHTDQGCYPTCMVWYPPLTRELFLLICNSGYKVKLFNATTKMCRKTLLGPAYGSPIEQTQVLPVRSMAELQKRYLVFINRDKVGLQILPVDGNPHKTSAIVCHPNGVAGMAVSYDGCYAFTAGGHDRSVVQWKITLSHPGSQAPILSPSDTSRS

SEQ ID NO: 38171 - protein, 220 aa, Homo sapiens
  ENSP00000219454
MPLTGVGPGSCRRQIIRALCLLLLLLHAGSAKNIWKRALPARLAEKSRAEEAGAPGGPRQPRADRCPPPPRTLPPGACQAARCQADSECPRHRRCCYNGCAYACLEAVPPPPVLDWLVQPKPRWLGGNGWLLDGPEEVLQAEACSTTEDGAEPLLCPSGYECHILSPGDVAEGIPNRGQCVKQRRQADGRILRHKLYKEYPEGDSKNVAEPGRGQQKHFQ

SEQ ID NO: 38172 - protein, 220 aa, Homo sapiens; identical to SEQ ID NO: 38171
  ENSP00000456920

SEQ ID NO: 38173 - protein, 66 aa, Homo sapiens
  ENSP00000481580
MPLTGVGPGSCRRQIIRALCLLLLLLHAGSAKNIWKRALPARLAEKSRVSAWDGEAGAACVGGSQP

SEQ ID NO: 38174 - protein, 890 aa, Homo sapiens
  ENSP00000423337
MDSNTAPLGPSCPQPPPAPQPQARSRLNATASLEQERSERPRAPGPQAGPGPGVRDAAAPAEPQAQHTRSRERADGTGPTKGDMEIPFEEVLERAKAGDPKAQTEVGKHYLQLAGDTDEELNSCTAVDWLVLAAKQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSESKNYIALDDFVEITKKYAKGVIPSSLFLQDDEDDDELAGKSPEDLPLRLKVVKYPLHAIMEIKEYLIDMASRAGMHWLSTIIPTHHINALIFFFIVSNLTIDFFAFFIPLVIFYLSFISMVICTLKVFQDSKAWENFRTLTDLLLRFEPNLDVEQAEVNFGWNHLEPYAHFLLSVFFVIFSFPIASKDCIPCSELAVITGFFTVTSYLSLSTHAEPYTRRALATEVTAGLLSLLPSMPLNWPYLKVLGQTFITVPVGHLVVLNVSVPCLLYVYLLYLFFRMAQLRNFKGTYCYLVPYLVCFMWCELSVVILLESTGLGLLRASIGYFLFLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 38175 - protein, 890 aa, Homo sapiens; identical to SEQ ID NO: 38174
  ENSP00000226760

SEQ ID NO: 38176 - protein, 252 aa, Homo sapiens
  ENSP00000424103
  MOD_RES (1)..(1): Any amino acid
XQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSELWGAHAVFSHASAKNYIALDDFVEITKKYAKGVIPSSLFLQDDEDDDELAGKSPEDLPLRLKVVKYPLHAIMEIKEYLIDMASRAGMHWLSTIIPTHHINALIFFFIVSNLTIDFFAFFIPLVIFYLSFISMVICTLKVFQDSKAWENF

SEQ ID NO: 38177 - protein, 379 aa, Homo sapiens
  ENSP00000286574
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 38178 - protein, 128 aa, Homo sapiens
  ENSP00000439024
GVNCDKANCSTTCFNGGTCFYPGKCICPPGLEGEQCEISKCPQPCRNGGKCIGKSKSVCEPGCGAHGTCHEPNKCQCQEGWHGRHCNKRYEASLIHALRPAGAQLRQHTPSLKKAEERRDPPESNYIW

SEQ ID NO: 38179 - protein, 133 aa, Homo sapiens
  ENSP00000442063
MAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNER

SEQ ID NO: 38180 - protein, 82 aa, Homo sapiens
  ENSP00000465695
  MOD_RES (1)..(1): Any amino acid
XEENKENDLRPSLPQSYAATVARPSASSASTVPGYSEDGGALRGEVIPEHEFATGPVCLDDENEFPPIILCRGNQKGKTKQS

SEQ ID NO: 38181 - protein, 446 aa, Homo sapiens
  ENSP00000262139
MEAEAADAPPGGVESALSCFSFNQDCTSLATGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 38182 - protein, 369 aa, Homo sapiens
  ENSP00000465470
MEAEAADAPPGGVESALSCFSFNQDCTSLATGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNRQSTRRAFDLEWLHGKDVYGCYQLPPYPGVRHDASGQGFCHCTLELLRTEEHLYPLNDPEVATAASCVIQWTPLYVQFGSSGWRRVCLNQNPQLAWLRNNRRE

SEQ ID NO: 38183 - protein, 54 aa, Homo sapiens
  ENSP00000465557
  MOD_RES (1)..(1): Any amino acid
XVARPSASSASTVPGYSEDGGALRGEVIPEHEFATGPVCLDDENEFPPVSIRNP

SEQ ID NO: 38184 - protein, 364 aa, Homo sapiens
  ENSP00000437345
MNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPIILCRGNQKGKTKQS

SEQ ID NO: 38185 - protein, 205 aa, Homo sapiens
  ENSP00000466270
VTISSLVFSMDSQFLCASSNTETVHIFKLEQVTNSRPEEPSTWSGYMGKMFMAATNYLPTQVSDMMHQDRAFATARLNFSGQRNICTLSTIQKLPRLLVASSSGHLYMYNLDPQDGGECVLIKTHSLLGSGTTEENKENDLRPSLPQSYAATVARPSASSASTVPGYSEDGGALRGEVIPEHEFATGPVCLDDENEFPPVSIRNP

SEQ ID NO: 38186 - protein, 543 aa, Homo sapiens
  ENSP00000346829
MAGAIIENMSTKKLCIVGGILLVFQIIAFLVGGLIGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 38187 - protein, 541 aa, Homo sapiens
  ENSP00000262348
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 38188 - protein, 450 aa, Homo sapiens
  ENSP00000360015
MAGAIIENMSTKKLCIVGGILLVFQIIAFLVGGLIGENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 38189 - protein, 200 aa, Homo sapiens
  ENSP00000431552
  MOD_RES (1)..(1): Any amino acid
XNMSTKKLCIVGGILLVFQIIAFLVGGLIGENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWML

SEQ ID NO: 38190 - protein, 134 aa, Homo sapiens
  ENSP00000433690
MDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLE

SEQ ID NO: 38191 - protein, 222 aa, Homo sapiens
  ENSP00000433111
MSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLE

SEQ ID NO: 38192 - protein, 122 aa, Homo sapiens
  ENSP00000360012
MDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRR

SEQ ID NO: 38193 - protein, 152 aa, Homo sapiens
  ENSP00000436196
MSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLL

SEQ ID NO: 38194 - protein, 38 aa, Homo sapiens
  ENSP00000433188
MAGAIIENMSTKKLCIVGGILLVFQIIAFLVGGLIAYP

SEQ ID NO: 38195 - protein, 152 aa, Homo sapiens
  ENSP00000433867
  MOD_RES (1)..(1): Any amino acid
XFPSNQLREGNVIDFIRNNRRVGELCPAQTRSSVTRLRYLHAPGPTTAVSYMSVKCVDARKNHHKTKWFVPWGPNHCDKIRDIEEAIPREIEANDIVFSVHIPLPHMEMSPWFQFMLFILQLDIAFKLNNQITMNRTSEKSLGVWQTRSYYT

SEQ ID NO: 38196 - protein, 127 aa, Homo sapiens
  ENSP00000360010
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIS

SEQ ID NO: 38197 - protein, 365 aa, Homo sapiens
  ENSP00000233948
MLPPLPSRLGLLLLLLLCPAHVGGLWWAVGSPLVMDPTSICRKARRLAGRQAELCQAEPEVVAELARGARLGVRECQFQFRFRRWNCSSHSKAFGRILQQDIRETAFVFAITAAGASHAVTQACSMGELLQCGCQAPRGRAPPRPSGLPGTPGPPGPAGSPEGSAAWEWGGCGDDVDFGDEKSRLFMDARHKRGRGDIRALVQLHNNEAGRLAVRSHTRTECKCHGLSGSCALRTCWQKLPPFREVGARLLERFHGASRVMGTNDGKALLPAVRTLKPPGRADLLYAADSPDFCAPNRRTGSPGTRGRACNSSAPDLSGCDLLCCGRGHRQESVQLEENCLCRFHWCCVVQCHRCRVRKELSLCL

SEQ ID NO: 38198 - protein, 349 aa, Homo sapiens
  ENSP00000285018
MNRKARRCLGHLFLSLGMVYLRIGGFSSVVALGASIICNKIPGLAPRQRAICQSRPDAIIVIGEGSQMGLDECQFQFRNGRWNCSALGERTVFGKELKVGSREAAFTYAIIAAGVAHAITAACTQGNLSDCGCDKEKQGQYHRDEGWKWGGCSADIRYGIGFAKVFVDAREIKQNARTLMNLHNNEAGRKILEENMKLECKCHGVSGSCTTKTCWTTLPQFRELGYVLKDKYNEAVHVEPVRASRNKRPTFLKIKKPLSYRKPMDTDLVYIEKSPNYCEEDPVTGSVGTQGRACNKTAPQASGCDLMCCGRGYNTHQYARVWQCNCKFHWCCYVKCNTCSERTEMYTCK

SEQ ID NO: 38199 - protein, 349 aa, Homo sapiens
  ENSP00000341032
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 38200 - protein, 353 aa, Homo sapiens
  ENSP00000386546
MLLLSPRSALVSVYCPQIFLLLSSGSYLALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 38201 - protein, 333 aa, Homo sapiens
  ENSP00000386781
MSAPPFYRALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 38202 - protein, 205 aa, Homo sapiens
  ENSP00000387217
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKGLLGQPRVTSSPLFP

SEQ ID NO: 38203 - protein, 57 aa, Homo sapiens
  ENSP00000392750
MGINECQYQFRFGRWNCSALGEKTVFGQELRVGSREAAFTYAITAAGVAHAVTAACS

SEQ ID NO: 38204 - protein, 44 aa, Homo sapiens
  ENSP00000461865
MAKPFFRLQKFLRRTQFLLFFLTAAYLMTGSLLLLQRVRVALPQ

SEQ ID NO: 38205 - protein, 575 aa, Homo sapiens
  ENSP00000460825
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 38206 - protein, 459 aa, Homo sapiens
  ENSP00000460396
MAEQGRCCDLAALGEQGGAPPWEKSLGTYIGCFSDDGHERTLKGAVFYDLRKMTVSHCQDACAERSYVYAGLEAGAECYCGNRLPAVSVGLEECNHECKGEKGSVCGAVDRLSVYRVDELQPGSRKRRTATYRGCFRLPENITHAFPSSLIQANVTVGTCSGFCSQKEFPLAILRGWECYCAYPTPRFNLRDAMDSSVCGQDPEAQRLAEYCEVYQTPVQDTRCTDRRFLPNKSKVFVALSSFPGAGNTWARHLIEHATGFYTGSYYFDGTLYNKGFKGEKDHWRSRRTICVKTHESGRREIEMFDSAILLIRNPYRSLVAEFNRKCAGHLGYAADRNWKSKEWPDFVNSYASWWSSHVLDWLKYGKRLLVVHYEELRRSLVPTLREMVAFLNVSVSEERLLCVENNKEGSFRRRGRRSHDPEPFTPEMKDLINGYIRTVDQALRDHNWTGLPREYVPR

SEQ ID NO: 38207 - protein, 180 aa, Homo sapiens
  ENSP00000460041
MAKPFFRLQKFLRRTQFLLFFLTAAYLMTGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGTYIGCFSDDGHERTLKGAVFYDLRKMTVSHCQDACAE

SEQ ID NO: 38208 - protein, 575 aa, Homo sapiens; identical to SEQ ID NO: 38205
  ENSP00000458374

SEQ ID NO: 38209 - protein, 87 aa, Homo sapiens
  ENSP00000458527
MAKPFFRLQKFLRRTQFLLFFLTAAYLMTGSLLLLQRVRVALPQGPRAPGPLQTLPVAAVALGVGLLDSRALHDPRVSPELLLGVDM

SEQ ID NO: 38210 - protein, 45 aa, Homo sapiens
  ENSP00000461642
MAKPFFRLQKFLRRTQFLLFFLTAAYLMTGSLLLLQRVRVALPQG

SEQ ID NO: 38211 - protein, 136 aa, Homo sapiens
  ENSP00000458339
  MOD_RES (1)..(1): Any amino acid
XGSLLLLQRVRVALPQGPRAPGPLQTLPVAAVALGVGLLDSRALHDPRVSPELLLGVDMLQSPLTRPRPGPRWLRSRNSELRQLRRRWFHHFMSDSQGPPALGPEAARPAIHSRGPMSTPAWRPGRSVTAGTGCQR

SEQ ID NO: 38212 - protein, 26 aa, Homo sapiens
  ENSP00000460428
MTVSHCQDACAERSYVYAGLEAGAEC

SEQ ID NO: 38213 - protein, 575 aa, Homo sapiens; identical to SEQ ID NO: 38205
  ENSP00000323087

SEQ ID NO: 38214 - protein, 575 aa, Homo sapiens; identical to SEQ ID NO: 38205
  ENSP00000446032

SEQ ID NO: 38215 - protein, 565 aa, Homo sapiens
  ENSP00000448047
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 38216 - protein, 123 aa, Homo sapiens
  ENSP00000446744
MTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALA

SEQ ID NO: 38217 - protein, 565 aa, Homo sapiens; identical to SEQ ID NO: 38215
  ENSP00000331933

SEQ ID NO: 38218 - protein, 585 aa, Homo sapiens
  ENSP00000447272
MAKLWFKFQRYFRRKPVRFFTFLALYLTAGSLVFLHSGFVGQPAVSGNQANPAAAGGPAEGAELSFLGDMHLGRGFRDTGEASSIARRYGPWFKGKDGNERAKLGDYGGAWSRALKGRVVREKEEERAKYIGCYLDDTQSRALRGVSFFDYKKMTIFRCQDNCAERGYLYGGLEFGAECYCGHKIQATNVSEAECDMECKGERGSVCGGANRLSVYRLQLAQESARRYGSAVFRGCFRRPDNLSLALPVTAAMLNMSVDKCVDFCTEKEYPLAALAGTACHCGFPTTRFPLHDREDEQLCAQKCSAEEFESCGTPSYFIVYQTQVQDNRCMDRRFLPGKSKQLIALASFPGAGNTWARHLIELATGFYTGSYYFDGSLYNKGFKGERDHWRSGRTICIKTHESGQKEIEAFDAAILLIRNPYKALMAEFNRKYGGHIGFAAHAHWKGKGAVPGSLQILFRSICTASVGEWPEFVRNYAPWWATHTLDWLKFGKKVLVVHFEDLKQDLFVQLGRMVSLLGVAVREDRLLCVESQKDGNFKRSGLRKLEYDPYTADMQKTISAYIKMVDAALKGRNLTGVPDDYYPR

SEQ ID NO: 38219 - protein, 1113 aa, Homo sapiens
  ENSP00000265293
MPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSSVKSLRSERLIRTSLDLELDLQATRTWHSQLTQEISVLKELKEQLEQAKSHGEKELPQWLREDERFRLLLRMLEKRQMDRAEHKGELQTDKMMRAAAKDVHRLRGQSCKEPPEVQSFREKMAFFTRPRMNIPALSADDV

SEQ ID NO: 38220 - protein, 1119 aa, Homo sapiens
  ENSP00000427772
MPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSPPPQPSSVKSLRSERLIRTSLDLELDLQATRTWHSQLTQEISVLKELKEQLEQAKSHGEKELPQWLREDERFRLLLRMLEKRQMDRAEHKGELQTDKMMRAAAKDVHRLRGQSCKEPPEVQSFREKMAFFTRPRMNIPALSADDV

SEQ ID NO: 38221 - protein, 1080 aa, Homo sapiens
  ENSP00000377473
  MOD_RES (1)..(1): Any amino acid
XRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKKIDKKMSDAQGSYKLDEAQAVLRETKAIKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSPPPQPSSVKSLRSERLIRTSLDLELDLQATRTWHSQLTQEISVLKELKEQLEQAKSHGEKELPQWLREDERFRLLLRMLEKRMDRAEHKGELQTDKMMRAAAKDVHRLRGQSCKEPPEVQSFREKMAFFTRPRMNIPALSADDV

SEQ ID NO: 38222 - protein, 889 aa, Homo sapiens
  ENSP00000429339
  MOD_RES (1)..(1): Any amino acid
XKKAITCGEKEKQDLIKSLAMLKDGFRTDRGSHSDLWSSSSSLESSSFPLPKQYLDVSSQTDISGSFGINSNNQLAEKVRLRLRYEEAKRRIANLKIQLAKLDSEAWPGVLDSERDRLILINEKEELLKEMRFISPRKWTQGEVEQLEMARKRLEKDLQAARDTQSKALTERLKLNSKRNQLVRELEEATRQVATLHSQLKSLSSSMQSLSSGSSPGSLTSSRGSLVASSLDSSTSASFTDLYYDPFEQLDSELQSKVEFLLLEGATGFRPSGCITTIHEDEVAKTQKAEGGGRLQALRSLSGTPKSMTSLSPRSSLSSPSPPCSPLMADPLLAGDAFLNSLEFEDPELSATLCELSLGNSAQERYRLEEPGTEGKQLGQAVNTAQGCGLKVACVSAAVSDESVAGDSGVYEASVQRLGASEAAAFDSDESEAVGATRIQIALKYDEKNKQFAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSSVKSLRSERLIRTSLDLELDLQATRTWHSQLTQEISVLKELKEQLEQAKSHGEKELPQWLREDERFRLLLRMLEKRMDRAEHKGELQTDKMMRAAAKDVHRLRGQSCKEPPEVQSFREKMAFFTRPRMNIPALSADDV

SEQ ID NO: 38223 - protein, 444 aa, Homo sapiens
  ENSP00000428084
FAILIIQLSNLSALLQQQDQKVNIRVAVLPCSESTTCLFRTRPLDASDTLVFNEVFWVSMSYPALHQKTLRVDVCTTDRSHLEECLGGAQISLAEVCRSGERSTRWYNLLSYKYLKKQSRELKPVGVMAPASGPASTDAVSALLEQTAVELEKRQEGRSSTQTLEDSWRYEETSENEAVAEEEEEEVEEEEGEEDVFTEKASPDMDGYPALKVDKETNTETPAPSPTVVRPKDRRVGTPSQGPFLRGSTIIRSKTFSPGPQSQYVCRLNRSDSDSSTLSKKPPFVRNSLERRSVRMKRPSPPPQPSSVKSLRSERLIRTSLDLELDLQATRTWHSQLTQEISVLKELKEQLEQAKSHGEKELPQWLREDERFRLLLRMLEKRMDRAEHKGELQTDKMMRAAAKDVHRLRGQSCKEPPEVQSFREKMAFFTRPRMNIPALSADDV

SEQ ID NO: 38224 - protein, 1192 aa, Homo sapiens
  ENSP00000384222
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 38225 - protein, 81 aa, Homo sapiens
  ENSP00000423238
MPRRAGSGQLPLPRGWEEARDYDGKVFYIDHNTRRTSWIDPRDRLTKPLSFADCVGDELPWGWEAGFDPQIGVYYIDHINS

SEQ ID NO: 38226 - protein, 1143 aa, Homo sapiens
  ENSP00000425054
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDYVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 38227 - protein, 1216 aa, Homo sapiens
  ENSP00000398577
MPRRAGSGQLPLPRGWEEARDYDGKVFYIDHNTRRTSWIDPRDRLTKPLSFADCVGDELPWGWEAGFDPQIGVYYIDHINKTTQIEDPRKQWRGEQEKMLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLNTYFLCCWELKDDVFTRLTVKPLLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 38228 - protein, 77 aa, Homo sapiens
  ENSP00000393342
MLKDYLSVAQDALRTQKELYHVKEQRLALALDEYVRLNDAYKEKSSSHTSLFSGSSSSTKYDPDILKAEISTTRLRN

SEQ ID NO: 38229 - protein, 712 aa, Homo sapiens
  ENSP00000413521
MLKDYLSVAQDALRTQKELYHVKEQRLALALDEYVRLNDAYKEKSSSHTSLFSGSSSSTKYDPDILKAEISTTRLRVKKLKRELSQMKQELLYKEQGFETLQQIDKKMSGGQSGYELSEAKAILTELKSIRKAISSGEKEKQDLMQSLAKLQERFHLDQNIGRSEPDLRCSPVNSHLCLSRQTLDAGSQTSISGDIGVRSRSNLAEKVRLSLQYEEAKRSMANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRKNFTFVTAITHGVCLPLPVPMPSFA

SEQ ID NO: 38230 - protein, 874 aa, Homo sapiens
  ENSP00000427569
MANLKIELSKLDSEAWPGALDIEKEKLMLINEKEELLKELQFVTPQKRTQDELERLEAERQRLEEELLSVRGTPSRALAERLRLEERRKELLQKLEETTKLTTYLHSQLKSLSASTLSMSSGSSLGSLASSRGSLNTSSRGSLNSLSSTELYYSSQSDQIDVDYQYKLDFLLQEKSGYIPSGPITTIHENEVVKSPSQPGQSGLCGVAAAATGHTPPLAEAPKSVASLSSRSSLSSLSPPGSPLVLEGTFPMSSSHDASLHQFTADFEDCELSSHFADISLIENQILLDSDSGGASQSLSEDKDLNECAREPLYEGTADVEKSLPKRRVIHLLGEKTTCVSAAVSDESVAGDSGVYEAFVKQPSEMEDVTYSEEDVAIVETAQVQIGLRYNAKSSSFMVIIAQLRNLHAFLIPHTSKVYFRVAVLPSSTDVSCLFRTKVHPPTESILFNDVFRVAISQTALQQKTLRVDLCSVSKHRREECLAGTQISLADLPFSSEVFTLWYNLLPSKQMPCKKNEENEDSVFQPNQPLVDSIDLDAVSALLARTSAELLAVEQELAQEEEEESGQEEPRGPDGDWLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 38231 - protein, 320 aa, Homo sapiens
  ENSP00000420835
MPRLRVHGACLPTKSVLFLFYHRLTMLREASDEIVAEKEAEVKLPEDSSCTEDLSSCTSVPEMNEDGNRKESNCAKDLRSQPPTRIPTLVDKETNTDEAANDNMAVRPKERSSLSSRQHPFVRSSVIVRSQTFSPGERNQYICRLNRSDSDSSTLAKKSLFVRNSTERRSLRVKRTVCQSVLRRTTQECPVRTSLDLELDLQASLTRQSRLNDELQALRDLRQKLEELKAQGETDLPPGVLEDERFQRLLKQAEKQAEQSKEEQKQGLNAEKLMRQVSKDVCRLREQSQKVPRQVQSFREKIAYFTRAKISIPSLPADDV

SEQ ID NO: 38232 - protein, 579 aa, Homo sapiens
  ENSP00000477059
MAAKSDGAAASASPDPEGAAGGARGSAGGRGEAAAAAGPPGVVGAGGPGPRYELRDCCWVLCALLVFFSDGATDLWLAASYYLQNQHTYFSLTLLFVLLPSLVVQLLSFRWFVYDYSEPAGSPGPAVSTKDSVAGGAAISTKDSAGAFRTKEGSPEPGPQPAPSSASAYRRRCCRLCIWLLQTLVHLLQLGQVWRYLRALYLGLQSRWRGERLRRHFYWQMLFESADVSMLRLLETFLRSAPQLVLQLSLLVHRGGAPDLLPALSTSASLVSLAWTLASYQKVLRDSRDDKRPLSYKGAVAQVLWHLFSIAARGLAFALFASVYKLYFGIFIVAHWCVMTFWVIQGETDFCMSKWEEIIYNMVVGIIYIFCWFNVKEGRSRRRMTLYHCIVLLENAALTGFWYSSRNFSTDFYSLIMVCVVASSFALGIFFMCVYYCLLHPNGPMLGPQAPGCIFRKASEPCGPPADAITSPPRSLPRTTGAERDGASAGERAGTPTPPVFQVRPGLPPTPVARTLRTEGPVIRIDLPRKKYPAWDAHFIDRRLRKTILALEYSSPATPRLQYRSVGTSQELLEYETTV

SEQ ID NO: 38233 - protein, 241 aa, Homo sapiens
  ENSP00000436390
MSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRVLSCTSGQNGGW

SEQ ID NO: 38234 - protein, 792 aa, Homo sapiens
  ENSP00000339918
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSETTKICSLPPIFEILPVKSLKARNQTLAPPFPELRYLSLAYNKIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 38235 - protein, 517 aa, Homo sapiens
  ENSP00000319303
MLDDNRLSNPSCFASLAGLRRLKKLSLDENRIIRIPYLQQVQLYDESVDWNGGRGSPHKEPQFMLQSKPRMLEDSDEQLDYTVLPMKKDVDRTEVVFSSYPGFSTSEIAKEDAVLPVALFPSLCEFVFHNNPLVAHTRGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRAQRIPIPPPKKTRAQLLDDIFIRLRDPRNITEAPLGAVLHQWTERRLVNHKQYLEAKRLLKEFQARYRQLVSGSLRTVFGTTPLPMACPALSESQPKFGHFLEFMDEFCQEPTASDSQG

SEQ ID NO: 38236 - protein, 115 aa, Homo sapiens
  ENSP00000433431
MLDDNRLSNPSCFASLAGLRRLKKLSLDENRIIRIPYLQQVQLYDESVDWNGGRGSPHKEPQFMLQSKPRMLEDSDEQLDYTVLPMKKDVDRTDRKRGCCPTSSSLPISLRVRLS

SEQ ID NO: 38237 - protein, 63 aa, Homo sapiens
  ENSP00000432689
  MOD_RES (1)..(1): Any amino acid
XRGSPHKEPQFMLQSKPRMLEDSDEQLDYTVLPMKKDVDRTDRKRGCCPTSSSLPISLRVRLS

SEQ ID NO: 38238 - protein, 598 aa, Homo sapiens
  ENSP00000435838
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRGSPHKEPQFMLQSKPRMLEDSDEQLDYTVLPMKKDVDRTGVPPLLKSFLQERLGIHLIRRKIVKPKHHVLMSRKESWKVKSEIPKVPKQPLVLHHPRMTTTKSPSKDMLEPEAELAEDLPTTKSTSVESEMPTENLEGHSPSCRTFVPLPPICSNSTVHSEETLSHLSDTTVRLSPERPSDEDSKSTESIFLTQVSELPSSVIHKDDLELKEKDQKKPPTAPREVKGTRRKLPTAFLPSKYHGYEELLTAKPDPAFIEPKGIQKNAQALQQMLKHPLLCHSSKPKLDTLQKPYVHKEKRVLSCTSGQNGGW

SEQ ID NO: 38239 - protein, 296 aa, Homo sapiens
  ENSP00000437334
MAFSGIYKLDDGKPYLNNCFPARNLLRVPEEGQGHWLVVQKGNLKKKPKGLVGAQAERRESLKATSFEFKGKKESRRENQVDLPGHILDQAFLLKHHCVRKPSDLCTINVSGLKFSKAKENDFKHFHSVIYINASENLLPLEAFHTFPALKELDLAFNGIKTIYVKYGDFKLLEFLDLSFNSLTVEAICDLGILPHLRVLLLTGNGLTSLPPNLAVAEQEASVTSLTSKRYILRFPALETLMLDDNRLSNPSCFASLAGLRRLKKLSLDENRIIRIPYLQQVQLYDESVDWNGGRG

SEQ ID NO: 38240 - protein, 55 aa, Homo sapiens
  ENSP00000435662
MLDDNRLSNPSCFASLAGLRRLKKLSLDENRIIRIPYLQQVQLYDESVDWNGGRG

SEQ ID NO: 38241 - protein, 19 aa, Homo sapiens
  ENSP00000433940
MLDDNRLSNPSCFASLAGL

SEQ ID NO: 38242 - protein, 959 aa, Homo sapiens
  ENSP00000261381
MVAAPCARRLARRSHSALLAALTVLLLQTLVVWNFSSLDSGAGERRGGAAVGGGEQPPPAPAPRRERRDLPAEPAAARGGGGGGGGGGGGRGPQARARGGGPGEPRGQQPASRGALPARALDPHPSPLITLETQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPHARKTGGSSPETKYDQPPKCDISGKEAISALSRAKSKHCRQEIGETYCRHKLGLLMPEKVTRFCPLEGKANKNVQWDEDSVEYMPANPVRIAFVLVVHGRASRQLQRMFKAIYHKDHFYYIHVDKRSNYLHRQVLQVSRQYSNVRVTPWRMATIWGGASLLSTYLQSMRDLLEMTDWPWDFFINLSAADYPIRTNDQLVAFLSRYRDMNFLKSHGRDNARFIRKQGLDRLFLECDAHMWRLGDRRIPEGIAVDGGSDWFLLNRRFVEYVTFSTDDLVTKMKQFYSYTLLPAESFFHTVLENSPHCDTMVDNNLRITNWNRKLGCKCQYKHIVDWCGCSPNDFKPQDFHRFQQTARPTFFARKFEAVVNQEIIGQLDYYLYGNYPAGTPGLRSYWENVYDEPDGIHSLSDVTLTLYHSFARLGLRRAETSLHTDGENSCRYYPMGHPASVHLYFLADRFQGFLIKHHATNLAVSKLETLETWVMPKKVFKIASPPSDFGRLQFSEVGTDWDAKERLFRNFGGLLGPMDEPVGMQKWGKGPNVTVTVIWVDPVNVIAATYDILIESTAEFTHYKPPLNLPLRPGVWTVKILHHWVPVAETKFLVAPLTFSNRQPIKPEEALKLHNGPLRNAYMEQSFQSLNPVLSLPINPAQVEQARRNAASTGTALEGWLDSLVGGMWTAMDICATGPTACPVMQTCSQTAWSSFSPDPKSELGAVKPDGRLR

SEQ ID NO: 38243 - protein, 364 aa, Homo sapiens
  ENSP00000007699
MSEVEAAAGATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 38244 - protein, 164 aa, Homo sapiens
  ENSP00000459587
  MOD_RES (1)..(1): Any amino acid
XAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 38245 - protein, 548 aa, Homo sapiens
  ENSP00000464380
MLDLIMGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 38246 - protein, 543 aa, Homo sapiens
  ENSP00000462468
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 38247 - protein, 543 aa, Homo sapiens; identical to SEQ ID NO: 38246
  ENSP00000324740

SEQ ID NO: 38248 - protein, 257 aa, Homo sapiens
  ENSP00000274496
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 38249 - protein, 257 aa, Homo sapiens; identical to SEQ ID NO: 38248
  ENSP00000397704

SEQ ID NO: 38250 - protein, 203 aa, Homo sapiens
  ENSP00000425422
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 38251 - protein, 177 aa, Homo sapiens
  ENSP00000429777
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISAL

SEQ ID NO: 38252 - protein, 101 aa, Homo sapiens
  ENSP00000428715
MMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGI

SEQ ID NO: 38253 - protein, 256 aa, Homo sapiens
  ENSP00000412696
MSNLAQFDSDFYQSNFTIDNQEQSGNDSNAYGNLYGSRKQQAGEQPQPASFVPSEMLMSSGYAGQFFQPASNSDYYSQSPYIDSFDEEPPLLEELGIHFDHIWQKTLTVLNPMKPVDGSIMNETDLTGPILFCVALGATLLLAGKVQFGYVYGMSAIGCLVIHALLNLMSSSGVSYGCVASVLGYCLLPMVILSGCAMFFSLQGIFGIMSSLVIIGWCSLSASKIFIAALHMEGQQLLVAYPCAILYGLFALLTIF

SEQ ID NO: 38254 - protein, 39 aa, Homo sapiens
  ENSP00000477355
MSNLAQFDSDFYQSNFTIDNQEQSGNDSNAYGNLYGSRK

SEQ ID NO: 38255 - protein, 280 aa, Homo sapiens
  ENSP00000332772
MDLLKISHTKLHLLEDLSIKNKQRMSNLAQFDSDFYQSNFTIDNQEQSGNDSNAYGNLYGSRKQQAGEQPQPASFVPSEMLMSSGYAGQFFQPASNSDYYSQSPYIDSFDEEPPLLEELGIHFDHIWQKTLTVLNPMKPVDGSIMNETDLTGPILFCVALGATLLLAGKVQFGYVYGMSAIGCLVIHALLNLMSSSGVSYGCVASVLGYCLLPMVILSGCAMFFSLQGIFGIMSSLVIIGWCSLSASKIFIAALHMEGQQLLVAYPCAILYGLFALLTIF

SEQ ID NO: 38256 - protein, 673 aa, Homo sapiens
  ENSP00000338157
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 38257 - protein, 115 aa, Homo sapiens
  ENSP00000437716
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLE

SEQ ID NO: 38258 - protein, 148 aa, Homo sapiens
  ENSP00000443013
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDR

SEQ ID NO: 38259 - protein, 673 aa, Homo sapiens; identical to SEQ ID NO: 38256
  ENSP00000376721

SEQ ID NO: 38260 - protein, 55 aa, Homo sapiens
  ENSP00000445047
  MOD_RES (1)..(1): Any amino acid
XGGLLPQGFIQRELFSKLGELAVGMKSESRTIGEQCSVCGVELPDNEAVEQHRVF

SEQ ID NO: 38261 - protein, 865 aa, Homo sapiens
  ENSP00000381517
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 38262 - protein, 1066 aa, Homo sapiens
  ENSP00000308759
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFGELEGTRPNKKFKCKHCLKIFRSTAGLHRHVNMYHNPEKPYACDICHKRFHTNFKVWTHCQTQHGIVKNPSPASSSHAVLDEKFQRKLIDIVREREIKKALIIKLRRGKPGFQGQSSSQAQQVIKRNLRSRAKGAYICTYCGKAYRFLSQFKQHIKMHPGEKPLGVNKVAKPKEHAPLASPVENKEVYQCRLCNAKLSSLLEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 38263 - protein, 1066 aa, Homo sapiens; identical to SEQ ID NO: 38262
  ENSP00000381512

SEQ ID NO: 38264 - protein, 1066 aa, Homo sapiens; identical to SEQ ID NO: 38262
  ENSP00000381523

SEQ ID NO: 38265 - protein, 118 aa, Homo sapiens
  ENSP00000387788
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIV

SEQ ID NO: 38266 - protein, 49 aa, Homo sapiens
  ENSP00000395186
MEGLLHYINPAHAISLLSALNEERLKGQLCDVLLIVGDQKFRAHKNVLA

SEQ ID NO: 38267 - protein, 49 aa, Homo sapiens; identical to SEQ ID NO: 38266
  ENSP00000381510

SEQ ID NO: 38268 - protein, 589 aa, Homo sapiens
  ENSP00000245663
MNNRKEDMEITSHYRHLLRELNEQRQHGVLCDVCVVVEGKVFKAHKNVLLGSSRYFKTLYCQVQKTSEQATVTHLDIVTAQGFKAIIDFMYSAHLALTSRNVIEVMSAASFLQMTDIVQACHDFIKAALDISIKSDASDELAEFEIGASSSSSTEALISAVMAGRSISPWLARRTSPANSSGDSAIASCHDGGSSYGKEDQEPKADGPDDVSSQPLWPGDVGYGPLRIKEEQVSPSQYGGSELPSAKDGAVQNSFSEQSAGDAWQPTGRRKNRKNKETVRHITQQVEDDSRASSPVPSFLPTSGWPFSSRDSNADLSVTEASSSDSRGERAELYAQVEEGLLGGEASYLGPPLTPEKDDALHQATAVANLRAALMSKNSLLSLKADVLGDDGSLLFEYLPRGAHSLSLNEFTVIRKKFKCPYCSFSAMHQCILKRHMRSHTGERPYPCEICGKKFTRREHMKRHTLVHSKDKKYVCKVCSRVFMSAASVGIRHGSRRHGVCTDCAGRGMAGPLDHGGGGGEGSPEALFPGDGPYLEDPEDPRGEAEELGEDDEGLAPEDALLADDKDEEDSPRPRSPPGGPDKDFAWLS

SEQ ID NO: 38269 - protein, 589 aa, Homo sapiens; identical to SEQ ID NO: 38268
  ENSP00000303102

SEQ ID NO: 38270 - protein, 589 aa, Homo sapiens; identical to SEQ ID NO: 38268
  ENSP00000378536

SEQ ID NO: 38271 - protein, 310 aa, Homo sapiens
  ENSP00000340590
MEKCTKSSSTMQVEPSFLQAENLILRLQMQHPTTENTAKRGQVMPALATTVMPVPYSLEHLTQFHGDPANCSEFLTQVTTYLTALQISNPANDAQIKLFFDYLSQQLESCGIISGPDKSTLLKQYENLILEFQQSFGKPTKQEINPLMNAKFDKGDNSSQQDPATFHLLAQNLICNETNQSGQFEKALADPNQDEESVTDMMDNLPDLITQCIQLDKKHSDRPELLQSETQLPLLASLIQHQALFSPTDPPPKKGPIQLREGQLPLTPAKRARQQETQLCLYCSQSGHFTRDCLAKRSRAPATTNNTAHQ

SEQ ID NO: 38272 - protein, 241 aa, Homo sapiens
  ENSP00000361411
MSLLSAIDTSAASVYQPAQLLNWVYLSLQDTHQASAFDAFRPEPTAGAAPPELAFGKGRPEQLGSPLHSSYLNSFFQLQRGEALSNSVYKGASPYGSLNNIADGLSSLTEHFSDLTLTSEARKPSKRPPPNYLCHLCFNKGHYIKDCPQARPKGEGLTPYQGKKRCFGEYKCPKCKRKWMSGNSWANMGQECIKCHINVYPHKQRPLEKPDGLDVSDQSKEHPQHLCEKCKVLGYYCRRVQ

SEQ ID NO: 38273 - protein, 228 aa, Homo sapiens
  ENSP00000361408
MQEVCSGEDTHGGHFPSRPGHTGAEQQCVQGRLTLWLPQQHRRWPQLPHRALLRPDPHLRGSQAQQAAPTQLPVPPVLQQRTLHQGLPPGTPQRRGPDSIPGQKALLRRVQVSQVQEKMDERELLGQHGAGVHQVPHQRVSTQAETPGEARRPGRVRPEQGAPAAPLREVQGPGLLLPSRAVTGCPPAPRATPRQPEETLLPCATPRGCVSPCAWGALAGLRGWAGGS

SEQ ID NO: 38274 - protein, 473 aa, Homo sapiens
  ENSP00000410713
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 38275 - protein, 488 aa, Homo sapiens
  ENSP00000352821
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 38276 - protein, 123 aa, Homo sapiens
  ENSP00000428211
  MOD_RES (1)..(1): Any amino acid
XCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVHSKQDS

SEQ ID NO: 38277 - protein, 109 aa, Homo sapiens
  ENSP00000345721
  MOD_RES (1)..(1): Any amino acid
XGGYRPPPRTKEVIINGQTVKLKYCFTCKIFRPPRASHCSLCDNCVVFIFAFVITHVILRSQQTGFLNALKDSPASVLEAVVCFFSVWSIVGLSGFHTYLISSNQTTNE

SEQ ID NO: 38278 - protein, 367 aa, Homo sapiens
  ENSP00000262096
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTCLVNQDPEQASTPAGLNSTAKNLENHQFPAKPLRESQSHLLTDSQSWTESSINPGKCKAGMSNPALTMENET

SEQ ID NO: 38279 - protein, 7 aa, Homo sapiens
  ENSP00000430804
MENTGEQ

SEQ ID NO: 38280 - protein, 130 aa, Homo sapiens
  ENSP00000430317
MENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLF

SEQ ID NO: 38281 - protein, 409 aa, Homo sapiens
  ENSP00000330485
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGLLG

SEQ ID NO: 38282 - protein, 403 aa, Homo sapiens
  ENSP00000417840
MKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGLLG

SEQ ID NO: 38283 - protein, 412 aa, Homo sapiens
  ENSP00000420251
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGKVLAHL

SEQ ID NO: 38284 - protein, 148 aa, Homo sapiens
  ENSP00000420292
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFS

SEQ ID NO: 38285 - protein, 236 aa, Homo sapiens
  ENSP00000492287
SGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGQYNRGFLRNWHQFSTLGTRAFHHPAEDIV

SEQ ID NO: 38286 - protein, 75 aa, Homo sapiens
  ENSP00000417579
YNVTEREVQQALRQKTGRRLLCGLIVDTDLSYSRTKYLIADIARGTFQVPGSLEEFQLPSYEVAVAFLLLLFPLS

SEQ ID NO: 38287 - protein, 70 aa, Homo sapiens
  ENSP00000492572
MSGLDDMTDSDSCLSRKKIKKTESGMYACDLCDKTFQKSSSLLRHKYEHTVYDSHASREEELSAWFWSGT

SEQ ID NO: 38288 - protein, 1102 aa, Homo sapiens
  ENSP00000490673
MKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 38289 - protein, 1102 aa, Homo sapiens; identical to SEQ ID NO: 38288
  ENSP00000490723

SEQ ID NO: 38290 - protein, 1102 aa, Homo sapiens; identical to SEQ ID NO: 38288
  ENSP00000490508

SEQ ID NO: 38291 - protein, 1102 aa, Homo sapiens; identical to SEQ ID NO: 38288
  ENSP00000490141

SEQ ID NO: 38292 - protein, 1102 aa, Homo sapiens; identical to SEQ ID NO: 38288
  ENSP00000490872

SEQ ID NO: 38293 - protein, 955 aa, Homo sapiens
  ENSP00000490934
MVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 38294 - protein, 1239 aa, Homo sapiens
  ENSP00000490317
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSDSSLGRQLQLLSNQGNVTVILIIILGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 38295 - protein, 1214 aa, Homo sapiens
  ENSP00000487174
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 38296 - protein, 220 aa, Homo sapiens
  ENSP00000394777
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGT

SEQ ID NO: 38297 - protein, 1214 aa, Homo sapiens; identical to SEQ ID NO: 38295
  ENSP00000386854

SEQ ID NO: 38298 - protein, 122 aa, Homo sapiens
  ENSP00000490175
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPESSLFLCLACLV

SEQ ID NO: 38299 - protein, 1202 aa, Homo sapiens
  ENSP00000490776
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRALPLRGTLTRRRGRVCRGMARARRSTRKKARMATGSWADRMATRSSRRKRKKVKIKVWIRIPKRYEMKKRLEITPWTIVRRMGKWKPNQTTRKTIWKMACNKLLHFKLPIFFSSSIVTCLKTLLC

SEQ ID NO: 38300 - protein, 1190 aa, Homo sapiens
  ENSP00000443792
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 38301 - protein, 1214 aa, Homo sapiens; identical to SEQ ID NO: 38295
  ENSP00000454157

SEQ ID NO: 38302 - protein, 1213 aa, Homo sapiens
  ENSP00000302501
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 38303 - protein, 21 aa, Homo sapiens
  ENSP00000489701
  MOD_RES (1)..(1): Any amino acid
XTFQKSSSLLRHKYEHTDSYD

SEQ ID NO: 38304 - protein, 731 aa, Homo sapiens
  ENSP00000395496
MTHFEDIEPACCRSRAPSPCELPSDPLLSMKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSN

SEQ ID NO: 38305 - protein, 612 aa, Homo sapiens
  ENSP00000490293
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKA

SEQ ID NO: 38306 - protein, 467 aa, Homo sapiens
  ENSP00000376601
MCVSEIEPACCRSRAPSPCELPSDPLLSMKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHL

SEQ ID NO: 38307 - protein, 184 aa, Homo sapiens
  ENSP00000475267
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPVKNANCTSDFEEYFAKRKLEERDGHAVSIEEYLQRSDTAIIYPEAPEELSRLGTPEANGQEENDLPPGTPDAFA

SEQ ID NO: 38308 - protein, 120 aa, Homo sapiens
  ENSP00000387256
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPVKNANCTSDF

SEQ ID NO: 38309 - protein, 141 aa, Homo sapiens
  ENSP00000487476
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCT

SEQ ID NO: 38310 - protein, 41 aa, Homo sapiens
  ENSP00000487261
MKQPIMADGPRCKRRKQANPRRKNGSSRLSEKAWTTCLSQH

SEQ ID NO: 38311 - protein, 91 aa, Homo sapiens
  ENSP00000400993
MKQPIMADGPRCKRRKQANPRRKNVVNYDNVVDTGSETDEEDKLHIAEDDGIANPLDQETSPASVPNHESSPHVSQALLPREEEEDEIREG

SEQ ID NO: 38312 - protein, 63 aa, Homo sapiens
  ENSP00000399451
MKQPIMADGPRCKRRKQANPRRKNVVNYDNVVDTGSETDEEDKLHIAEDDGIANPLDQETSPA

SEQ ID NO: 38313 - protein, 39 aa, Homo sapiens
  ENSP00000486346
MKQPIMADGPRCKRRKQANPRRKNVVNYDNVVDTGSETD

SEQ ID NO: 38314 - protein, 41 aa, Homo sapiens
  ENSP00000486341
MKQPIMADGPRCKRRKQANPRRKNAKTNHLNREINSTSVQH

SEQ ID NO: 38315 - protein, 58 aa, Homo sapiens
  ENSP00000475502
MKQPIMADGPRCKRRKQANPRRKNALESEMSTRSGRCPAAACHRCGPFVTCKVCCFCP

SEQ ID NO: 38316 - protein, 87 aa, Homo sapiens
  ENSP00000475329
MTHFEDIEPACCRSRAPSPCELPSDPLLSMKQPIMADGPRCKRRKQANPRRKNALESEMSTRSGRCPAAACHRCGPFVTCKVCCFCP

SEQ ID NO: 38317 - protein, 58 aa, Homo sapiens; identical to SEQ ID NO: 38315
  ENSP00000486240

SEQ ID NO: 38318 - protein, 36 aa, Homo sapiens
  ENSP00000490851
MKQPIMADGPRCKRRKQANPRRKNVSTWSGGARYPG

SEQ ID NO: 38319 - protein, 58 aa, Homo sapiens; identical to SEQ ID NO: 38315
  ENSP00000475400

SEQ ID NO: 38320 - protein, 423 aa, Homo sapiens
  ENSP00000475553
MADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKNSRRQWLMPVIPALWEANEGGSGQEFETSLANMVKHHLS

SEQ ID NO: 38321 - protein, 180 aa, Homo sapiens
  ENSP00000386031
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKIFTYRCSKEGCKKKEMLQMVCAQCHGNFCIQHRHPLDHSCRHGSRPTIKAGCSPMTVSESRPLGDFLTLAPGGLAQRLGYWFTRLM

SEQ ID NO: 38322 - protein, 205 aa, Homo sapiens
  ENSP00000380273
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKSLCSLRFLHTVAQKRAARRKRCCRWYVPNVTATSVSSTDTLWTTAADTGVAPPSKLGEKRLRCDGSEHAVACVEAAYTLVGSGAPLSTIPHWLLILFVEGDGTIIKLNAEV

SEQ ID NO: 38323 - protein, 145 aa, Homo sapiens
  ENSP00000314619
MEFPDLGKHCSEKTCKQLDFLPVKCDACKQDFCKDHFPYAAHKCPFAFQKDVHVPVCPLCNTPIPVKKGQIPDVVVGDHIDRDCDSHPGKKKEKIFTYRCSKEGCKKKEMLQMVCAQCHGNFCIQHRHPLDHSCRHGSRPTIKAG

SEQ ID NO: 38324 - protein, 90 aa, Homo sapiens
  ENSP00000459173
  MOD_RES (1)..(1): Any amino acid
XDACKQDFCKDHFPYAAHKCPFAFQKDVHVPVCPLCNTPIPVKKGQIPDVVVGDHIDRDCDSHPGKKKEKHRHPLDHSCRHGSRPTIKAG

SEQ ID NO: 38325 - protein, 213 aa, Homo sapiens
  ENSP00000366161
MAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRKKVGLTGFDCRCGNLFCGLHRYSDKHNCPYDYKAEAAAKIRKENPVVVAEKIQRI

SEQ ID NO: 38326 - protein, 213 aa, Homo sapiens; identical to SEQ ID NO: 38325
  ENSP00000366159

SEQ ID NO: 38327 - protein, 213 aa, Homo sapiens; identical to SEQ ID NO: 38325
  ENSP00000350586

SEQ ID NO: 38328 - protein, 211 aa, Homo sapiens
  ENSP00000366155
MAKPEQAADGGVRGRGARPPAQEAQRRRRHPVVVARDLAPGVPGSLHSTQKNMAQETNQTPGPMLCSTGCGFYGNPRTNGMCSVCYKEHLQRQQNSGRMSPMGTASGSNSPTSDSASVQRADTSLNNCEGAAGSTSEKSRNVPVAALPVTQQMTEMSISREDKITTPKTEVSEPVVTQPSPSVSQPSTSQSEEKAPELPKPKKNRCFMCRK

SEQ ID NO: 38329 - protein, 213 aa, Homo sapiens; identical to SEQ ID NO: 38325
  ENSP00000237937

SEQ ID NO: 38330 - protein, 208 aa, Homo sapiens
  ENSP00000261749
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 38331 - protein, 208 aa, Homo sapiens; identical to SEQ ID NO: 38330
  ENSP00000452735

SEQ ID NO: 38332 - protein, 196 aa, Homo sapiens
  ENSP00000454152
MAQETNHSQVPMLCSTGCGFYGNPRTNGMCSVCYKEHLQRQNSSNGRISPPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 38333 - protein, 72 aa, Homo sapiens
  ENSP00000453590
MSIRSFLESIFRCKQYSGLLLEIQRLRTRNYCMQQETLISSTYAKLGVQLRNMAQETNHSQVPMLCSTGCGF

SEQ ID NO: 38334 - protein, 148 aa, Homo sapiens
  ENSP00000454273
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQGFECRCGNVYCGVHRYSDVHNCSYNYK

SEQ ID NO: 38335 - protein, 208 aa, Homo sapiens; identical to SEQ ID NO: 38330
  ENSP00000454137

SEQ ID NO: 38336 - protein, 20 aa, Homo sapiens
  ENSP00000455515
MAQETNHSQVPMLCSTGCGF

SEQ ID NO: 38337 - protein, 32 aa, Homo sapiens
  ENSP00000454409
MAQETNHSQVPMLCSTGCGFYGNPRTNGMCSV

SEQ ID NO: 38338 - protein, 208 aa, Homo sapiens; identical to SEQ ID NO: 38330
  ENSP00000453291

SEQ ID NO: 38339 - protein, 208 aa, Homo sapiens; identical to SEQ ID NO: 38330
  ENSP00000453709

SEQ ID NO: 38340 - protein, 177 aa, Homo sapiens
  ENSP00000452664
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGKDLNQMFKIKMMFYNNA

SEQ ID NO: 38341 - protein, 87 aa, Homo sapiens
  ENSP00000455146
MAQETNHSQVPMLCSTGCGFYGNPRTNGMCSVCYKEHLQRQNSSNGRISPPATSVSSLSESLPVQCTDGSVPEAQSALDSTSSSMQP

SEQ ID NO: 38342 - protein, 155 aa, Homo sapiens
  ENSP00000453710
MKGFIFLKAIGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSL

SEQ ID NO: 38343 - protein, 64 aa, Homo sapiens
  ENSP00000456973
MAQETNHSQVPMLCSTGCGFYGNPRTNGMCSVCYKEHLQRQNSSNGRISPPATSVSSLSESLPV

SEQ ID NO: 38344 - protein, 158 aa, Homo sapiens
  ENSP00000453308
MKGFIFLKAIGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKP

SEQ ID NO: 38345 - protein, 159 aa, Homo sapiens
  ENSP00000453571
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLT

SEQ ID NO: 38346 - protein, 208 aa, Homo sapiens; identical to SEQ ID NO: 38330
  ENSP00000453888

SEQ ID NO: 38347 - protein, 174 aa, Homo sapiens
  ENSP00000452625
MLLLPNRDKGVQLRNMAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLT

SEQ ID NO: 38348 - protein, 208 aa, Homo sapiens; identical to SEQ ID NO: 38330
  ENSP00000484971

SEQ ID NO: 38349 - protein, 208 aa, Homo sapiens; identical to SEQ ID NO: 38330
  ENSP00000478129

SEQ ID NO: 38350 - protein, 208 aa, Homo sapiens; identical to SEQ ID NO: 38330
  ENSP00000479071

SEQ ID NO: 38351 - protein, 3616 aa, Homo sapiens
  ENSP00000430497
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLVNNELPPEIRLASGQLMGDDLSLLTAGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQQLRSTSEEQSEEAEGAIKPTAVAEDDEKDTSERDNSEGKNSNKDSGIITPEKELKVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 38352 - protein, 155 aa, Homo sapiens
  ENSP00000428525
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTG

SEQ ID NO: 38353 - protein, 101 aa, Homo sapiens
  ENSP00000429495
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCP

SEQ ID NO: 38354 - protein, 155 aa, Homo sapiens; identical to SEQ ID NO: 38352
  ENSP00000427775

SEQ ID NO: 38355 - protein, 140 aa, Homo sapiens
  ENSP00000427739
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAY

SEQ ID NO: 38356 - protein, 3590 aa, Homo sapiens
  ENSP00000430848
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQQLRSTSEEQSEEAEGAIKPTAVAEDDEKDTSERDNSEGKNSNKDSGIITPEKELKVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 38357 - protein, 82 aa, Homo sapiens
  ENSP00000431101
  MOD_RES (1)..(1): Any amino acid
XKVKLNLVQHVRSVKHQQTEGLRKLQLHQQGLAPEEDNLSEIFFVKDCPPNELETASLGARTCDDDLTEQQLRSTSAYLSTY

SEQ ID NO: 38358 - protein, 86 aa, Homo sapiens
  ENSP00000430375
  MOD_RES (1)..(1): Any amino acid
XKLNLVQHVRSVKHQQTEGLRKLQLHQQGLAPEEDNLSEIFFVKDCPPNELASSCQIFWSACNFLCTEPNRLISSRRNCLIGSQDL

SEQ ID NO: 38359 - protein, 69 aa, Homo sapiens
  ENSP00000451093
MVREIIVENISSGNLGQRVLFSGITSLSPPTSDQAPNLLPTRKSKGSLKTCCQRKGTLLKEEVESLRPG

SEQ ID NO: 38360 - protein, 338 aa, Homo sapiens
  ENSP00000388402
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 38361 - protein, 338 aa, Homo sapiens; identical to SEQ ID NO: 38360
  ENSP00000337386

SEQ ID NO: 38362 - protein, 207 aa, Homo sapiens
  ENSP00000450784
MGRARKSGLGQRSRPTASRSEAAVQGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHS

SEQ ID NO: 38363 - protein, 176 aa, Homo sapiens
  ENSP00000450600
MLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRL

SEQ ID NO: 38364 - protein, 189 aa, Homo sapiens
  ENSP00000452119
MGRARKSGLGQRSRPTASRSEAAVQPGVRKARGAGNWRVGLQTGEAAPSPHRDLRDTPDPRPWLARTHRMTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELC

SEQ ID NO: 38365 - protein, 499 aa, Homo sapiens
  ENSP00000411514
MKRPLSPPPPAEKETPISGAAECLPRPPEPPKPKRERKRPSYTLCDVCNIQLNSAAQAQVHCGGRAHQRRLRQLSLGKSPSGPAGPASGAPSPLLASLPLPTRPLQPPLDFKHLLAFHFNGAAPLSLFPNFSTMDPVQKAVISHTFGVPSPLKKKLFISCNICHLRFNSANQAEAHYKGHKHARKLKAVEAAKSKQRPHTQAQDGAVVSPIPTLASGAPGEPQSKAVPAAPPLGPPLQPPPTPDPTCREPAHSELLDAASSSSSSSCPPCSPEPGREAPGPEPAAAAVGSSMSGEGRSEKGHLYCPTCKVTVNSASQLQAHNTGAKHRWMMEGQRGAPRRSRGRPVSRGGAGHKAKRVTGGRGGRQGPSPAFHCALCQLQVNSETQLKQHMSSRRHKDRLAGKTPKPSSQHSKLQKHAALASKLALQKQLTKTLAARFLPSPLPTAATAICALPGPLALRPAPTAATTLFPAPILGPALFRTPAGAVRPATGPIVLAPY

SEQ ID NO: 38366 - protein, 424 aa, Homo sapiens
  ENSP00000480744
MGLAAGPASGAPSPLLASLPLPTRPLQPPLDFKHLLAFHFNGAAPLSLFPNFSTMDPVQKAVISHTFGVPSPLKKKLFISCNICHLRFNSANQAEAHYKGHKHARKLKAVEAAKSKQRPHTQAQDGAVVSPIPTLASGAPGEPQSKVPAAPPLGPPLQPPPTPDPTCREPAHSELLDAASSSSSSSCPPCSPEPGREAPGPEPAAAAVGSSMSGEGRSEKGHLYCPTCKVTVNSASQLQAHNTGAKHRWMMEGQRGAPRRSRGRPVSRGGAGHKAKRVTGGRGGRQGPSPAFHCALCQLQVNSETQLKQHMSSRRHKDRLAGKTPKPSSQHSKLQKHAALAVSILKSKLALQKQLTKTLAARFLPSPLPTAATAICALPGPLALRPAPTAATTLFPAPILGPALFRTPAGAVRPATGPIVLAPY

SEQ ID NO: 38367 - protein, 513 aa, Homo sapiens
  ENSP00000340494
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 38368 - protein, 30 aa, Homo sapiens
  ENSP00000427719
LPSGALSKSAPGSFWHIQADHAYQESPRGG

SEQ ID NO: 38369 - protein, 513 aa, Homo sapiens; identical to SEQ ID NO: 38367
  ENSP00000429640

SEQ ID NO: 38370 - protein, 513 aa, Homo sapiens; identical to SEQ ID NO: 38367
  ENSP00000428452

SEQ ID NO: 38371 - protein, 187 aa, Homo sapiens
  ENSP00000427934
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPP

SEQ ID NO: 38372 - protein, 156 aa, Homo sapiens
  ENSP00000430203
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVP

SEQ ID NO: 38373 - protein, 124 aa, Homo sapiens
  ENSP00000427812
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWL

SEQ ID NO: 38374 - protein, 102 aa, Homo sapiens
  ENSP00000429823
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEG

SEQ ID NO: 38375 - protein, 47 aa, Homo sapiens
  ENSP00000429649
MASVLSRRLGKRSLLGARVLGPSASEGPSAAPPSEPLLEGAAPQPFT

SEQ ID NO: 38376 - protein, 1284 aa, Homo sapiens
  ENSP00000455426
MHKKRVEEGEASDFSLAWDSSVTAAGGLEGEPECDQKTSRALEDRNSVTSQEERNEDDEDMEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 38377 - protein, 1224 aa, Homo sapiens
  ENSP00000455588
MEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 38378 - protein, 1224 aa, Homo sapiens; identical to SEQ ID NO: 38377
  ENSP00000457928

SEQ ID NO: 38379 - protein, 1167 aa, Homo sapiens
  ENSP00000442321
MIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 38380 - protein, 1167 aa, Homo sapiens; identical to SEQ ID NO: 38379
  ENSP00000455061

SEQ ID NO: 38381 - protein, 1224 aa, Homo sapiens; identical to SEQ ID NO: 38377
  ENSP00000457664

SEQ ID NO: 38382 - protein, 102 aa, Homo sapiens
  ENSP00000479288
  MOD_RES (1)..(1): Any amino acid
XEEGEASDFSLAWDSSVTAAGGLEGEPECDQKTSRALEDRNSVTSQEERNEDDEDMEDESIYTCDHCQQDFESLADLTDHRAHRCPGGNAKQPQDSDRWLHG

SEQ ID NO: 38383 - protein, 1284 aa, Homo sapiens; identical to SEQ ID NO: 38376
  ENSP00000262383

SEQ ID NO: 38384 - protein, 2506 aa, Homo sapiens
  ENSP00000277225
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWVRDTSEPQKEPNFRNITHDYNATNGAEIELTLSEDEEDYYGSSTNLKDHQVSNTALLNTQTPIYGTEHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 38385 - protein, 110 aa, Homo sapiens
  ENSP00000476222
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYAFWSLRRGAKDQGEESG

SEQ ID NO: 38386 - protein, 1449 aa, Homo sapiens
  ENSP00000363818
HCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 38387 - protein, 1412 aa, Homo sapiens
  ENSP00000397306
MMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKQEADDPAHLFLDGLEAAKDASGALVGRVDGEHCLLDGMLEDETRPGGYHCSQCDRVLMSMQGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 38388 - protein, 208 aa, Homo sapiens
  ENSP00000405837
  MOD_RES (1)..(1): Any amino acid
XEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHRGNLSNLVFLDAAGGRQQRWPSRDALSEWQ

SEQ ID NO: 38389 - protein, 1311 aa, Homo sapiens
  ENSP00000354794
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 38390 - protein, 1091 aa, Homo sapiens
  ENSP00000463000
MQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 38391 - protein, 1244 aa, Homo sapiens
  ENSP00000382352
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEDIVFSMTEETSAHANTTEIWNLSIASPRRPINASSVRWFSTMNGIFRFMLQIT

SEQ ID NO: 38392 - protein, 1311 aa, Homo sapiens; identical to SEQ ID NO: 38389
  ENSP00000440768

SEQ ID NO: 38393 - protein, 184 aa, Homo sapiens
  ENSP00000463748
  MOD_RES (1)..(1): Any amino acid
XQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDSKTKDL

SEQ ID NO: 38394 - protein, 224 aa, Homo sapiens
  ENSP00000462724
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVH

SEQ ID NO: 38395 - protein, 144 aa, Homo sapiens
  ENSP00000464415
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKL

SEQ ID NO: 38396 - protein, 30 aa, Homo sapiens
  ENSP00000462746
MSRRKQAKPRSLKDPNCKLEDKTEDGEALD

SEQ ID NO: 38397 - protein, 1085 aa, Homo sapiens
  ENSP00000427657
MRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKATNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRRE

SEQ ID NO: 38398 - protein, 1512 aa, Homo sapiens
  ENSP00000307746
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKATNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRRE

SEQ ID NO: 38399 - protein, 447 aa, Homo sapiens
  ENSP00000424086
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRTQIQEHGIIMYTSPNIWISKSQKNLIERRN

SEQ ID NO: 38400 - protein, 715 aa, Homo sapiens
  ENSP00000423279
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKE

SEQ ID NO: 38401 - protein, 707 aa, Homo sapiens
  ENSP00000421899
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLID

SEQ ID NO: 38402 - protein, 447 aa, Homo sapiens; identical to SEQ ID NO: 38399
  ENSP00000477767

SEQ ID NO: 38403 - protein, 1349 aa, Homo sapiens
  ENSP00000329638
MACYLVISSRHLSNGHYRGIKGVFRGPLCKNGSPSPDFAEKKSTAKALEDVKANFYCELCDKQYHKHQEFDNHINSYDHAHKQRLKELKQREFARNVASKSWKDEKKQEKALKRLHQLAELRQQSECVSGNGPAYKAPRVAIEKQLQQGIFPIKNGRKVSCMKSALLLKGKNLPRIISDKQRSTMPNRHQLQSDRRCLFGNQVLQTSSDLSNANHRTGVSFTFSKKVHLKLESSASVFSENTEETHDCNKSPIYKTKQTADKCKCCRFANKDTHLTKEKEVNISPSHLESVLHNTISINSKILQDKHDSIDETLEDSIGIHASFSKSNIHLSDVDFTPTSREKETRNTLKNTLENCVNHPCQANASFSPPNIYNHSDARISECLDEFSSLEPSEQKSTVHLNPNSRIENREKSLDKTERVSKNVQRLVKEACTHNVASKPLPFLHVQSKDGHTTLQWPTELLLFTKTEPCISYGCNPLYFDFKLSRNTKEDHNLEDLKTELGKKPLELKTKRESQVSGLTEDQQKLIQEDYQYPKPKTMIANPDWEKFQRKYNLDYSDSEPNKSEYTFSANDLEMKNPKVPLYLNTSLKDCAGKNNSSENKLKEASRAHWQGCRKAVLNDIDEDLSFPSYISRFKKHKLIPCSPHLEFEDERQFNCKSSPCTVGGHSDHGKDFSVILKSNHISMTSKVSGCGNQRYKRYSPQSCLSRYSSSLDTSPSSMSSLRSTCSSHRFNGNSRGNLLCFHKREHHSVERHKRKCLKHNCFYLSDDITKSSQMQSEPQKERNCKLWESFKNEKYSKRRYCHCRERQKLGKNQQQFSGLKSTRIIYCDSNSQISCTGSSKKPPNCQGTQHDRLDSYSIEKMYYLNKSKRNQESLGSPHICDLGKVRPMKCNSGNISCLLKNCSSGPSETTESNTAEGERTPLTAKILLERVQAKKCQEQSSNVEISSNSCKSELEAPSQVPCTIQLAPSGCNRQALPLSEKIQYASESRNDQDSAIPRTTEKDKSKSSHTNNFTILADTDCDNHLSKGIIHLVTESQSLNIKRDATTKEQSKPLISEIQPFIQSCDPVPNEFPGAFPSNKYTGVTDSTETQEDQINLDLQDVSMHINHVEGNINSYYDRTMQKPDKVEDGLEMCHKSISPPLIQQPITFSPDEIDKYKILQLQAQQHMQKQLLSKHLRVLPAAGPTAFSPASTVQTVPVHQHTSITTIHHTFLQHFAVSASLSSHSSHLPIAHLHPLSQAHFSPISFSTLTPTIIPAHPTFLAGHPLHLVAATPFHPSHITLQPLPPTAFIPTLFGPHLNPATTSIIHLNPLIQPVFQGQDFCHHSCSSQMQQLNEVKEALNVSTHLN

SEQ ID NO: 38404 - protein, 1266 aa, Homo sapiens
  ENSP00000478506
RLKELKQREFARNVASKSWKDEKKQEKALKRLHQLAELRQQSECVSGNGPAYKAPRVAIEKQLQQGIFPIKNGRKVSCMKSALLLKGKNLPRIISDKQRSTMPNRHQLQSDRRCLFGNQVLQTSSDLSNANHRTGVSFTFSKKVHLKLESSASVFSENTEETHDCNKSPIYKTKQTADKCKCCRFANKDTHLTKEKEVNISPSHLESVLHNTISINSKILQDKHDSIDETLEDSIGIHASFSKSNIHLSDVDFTPTSREKETRNTLKNTLENCVNHPCQANASFSPPNIYNHSDARISECLDEFSSLEPSEQKSTVHLNPNSRIENREKSLDKTERVSKNVQRLVKEACTHNVASKPLPFLHVQSKDGHTTLQWPTELLLFTKTEPCISYGCNPLYFDFKLSRNTKEDHNLEDLKTELGKKPLELKTKRESQVSGLTEDQQKLIQEDYQYPKPKTMIANPDWEKFQRKYNLDYSDSEPNKSEYTFSANDLEMKNPKVPLYLNTSLKDCAGKNNSSENKLKEASRAHWQGCRKAVLNDIDEDLSFPSYISRFKKHKLIPCSPHLEFEDERQFNCKSSPCTVGGHSDHGKDFSVILKSNHISMTSKVSGCGNQRYKRYSPQSCLSRYSSSLDTSPSSMSSLRSTCSSHRFNGNSRGNLLCFHKREHHSVERHKRKCLKHNCFYLSDDITKSSQMQSEPQKERNCKLWESFKNEKYSKRRYCHCRERQKLGKNQQQFSGLKSTRIIYCDSNSQISCTGSSKKPPNCQGTQHDRLDSYSIEKMYYLNKSKRNQESLGSPHICDLGKVRPMKCNSGNISCLLKNCSSGPSETTESNTAEGERTPLTAKILLERVQAKKCQEQSSNVEISSNSCKSELEAPSQVPCTIQLAPSGCNRQALPLSEKIQYASESRNDQDSAIPRTTEKDKSKSSHTNNFTILADTDCDNHLSKGIIHLVTESQSLNIKRDATTKEQSKPLISEIQPFIQSCDPVPNEFPGAFPSNKYTGVTDSTETQEDQINLDLQDVSMHINHVEGNINSYYDRTMQKPDKVEDGLEMCHKSISPPLIQQPITFSPDEIDKYKILQLQAQQHMQKQLLSKHLRVLPAAGPTAFSPASTVQTVPVHQHTSITTIHHTFLQHFAVSASLSSHSSHLPIAHLHPLSQAHFSPISFSTLTPTIIPAHPTFLAGHPLHLVAATPFHPSHITLQPLPPTAFIPTLFGPHLNPATTSIIHLNPLIQPVFQGQDFCHHSCSSQMQQLNEVKEALNVSTHLN

SEQ ID NO: 38405 - protein, 1677 aa, Homo sapiens
  ENSP00000490240
MEVPEPTCPAPPARDQPAPTPGPPGAPGGQASPHLTLGPVLLPPEQGLAPPTVFLKALPIPLYHTVPPGGLQPRAPLVTGSLDGGNVPFILSPVLQPEGPGPTQVGKPAAPTLTVNIVGTLPVLSPGLGPTLGSPGKVRNAGKYLCPHCGRDCLKPSVLEKHIRSHTGERPFPCATCGIAFKTQSNLYKHRRTQTHLNNSRLSSESEGAGGGLLEEGDKAGEPPRPEGRGESRCQGMHEGASERPLSPGAHVPLLAKNLDVRTEAAPCPGSAFADREAPWDSAPMASPGLPAASTQPWRKLPEQKSPTAGKPCALQRQQATAAEKPWDAKAPEGRLRKCESTDSGYLSRSDSAEQPHAPCSPLHSLSEHSAESEGEGGPGPGPGVAGAEPGAREAGLELEKKRLEERIAQLISHNQAVVDDAQLDNVRPRKTGLSKQGSIDLPTPYTYKDSFHFDIRALEPGRRRAPGPVRSTWTPPDKSRPLFFHSVPTQLSTTVECVPVTRSNSLPFVEGSRTWLEPREPRDPWSRTQKPLSPRPGPARLGCRSGLSSTDVPSGHPRALVRQAAVEDLPGTPIGDALVPAEDTDAKRTAAREAMAGKGRAGGRKCGQRRLKMFSQEKWQVYGDETFKRIYQKMKASPHGGKKAREVGMGSGAELGFPLQKEAAGSSGTVPTQDRRTPVHEDISAGATPEPWGNPPALEASLVTEPTKHGETVARRGDSDRPRVEEAVSSPALGGRDSPCSGSRSPLVSPNGRLELGWQMPPAPGPLKGGDVEAPRPVWPDPKLEGGARGVGDVQETCLWAQTVLRWPSRGSGEDKLPSERKKLKVEDLHSWKQPEPVSAETPGGPTQPASLSSQKQDADPGEVPGGSKESARQVGEPLESSGASLAAASVALKRVGPRDKATPLHPAAPAPAEHPSLATPPQAPRVLSALADNAFSPKYLLRLPQAETPLPLPIPWGPRHSQDSLCSSGWPEERASFVGSGLGTPLSPSPASGPSPGEADSILEDPSCSRPQDGRKGAQLGGDKGDRMATSRPAARELPISAPGAPREATSSPPTPTCEAHLVQDMEGDSHRIHRLCMGSTLARARLSGDVLNPWVPNWELGEPPGNAPEDPSSGPLVGPDPCSPLQPGSFLTALTRPQGVPPGWPELALSSHSGTSRSHSTRSPHSTQNPFPSLKAEPRLTWCCLSRSVPLPAEQKAKAASVYLAVHFPGSSLRDEGPNGPPGSNGGWTWTSPGEGGPAQMSKFSYPTVPGVMPQHQVSEPEWKKGLPWRAKMSRGNSKQRKLKINPKRYKGNFLQSCVQLRASRLRTPTWVRRRSRHPPALEGLKPCRTPGQTSSEIAGLNLQEEPSCATSESPPCCGKEEKKEGDCRQTLGTLSLGTSSRIVREMDKRTVKDISPSAGEHGDCTTHSTAATSGLSLQSDTCLAVVNDVPLPPGKGLDLGLLETQLLASQDSVSTDPKPYIFSDAQRPSSFGSKGTFPHHDIATSVAAVCISLPVRTDHIAQEIHSAESRDHSQTAGRTLTSSSPDSKVTEEGRAQTLLPGRPSSGQRISDSVPLESTEKTHLEIPASGPSSASSHHKEGRHKTFFPSRGQYGCGEMTVPCPSLGSDGRKRQVSGLITRKDSVVPSKPEQPIEIPEAPSKSLKKRSLEGMRKQTRVEFSDTSSDDEDRLVIEI

SEQ ID NO: 38406 - protein, 1677 aa, Homo sapiens; identical to SEQ ID NO: 38405
  ENSP00000360069

SEQ ID NO: 38407 - protein, 1006 aa, Homo sapiens
  ENSP00000326630
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPSPALTLLLVDEACWLRTLPQALTEAEANTEIHRKDDALWCRVTKPVPAGGLLSVLLTAEPHSTPGHPVKKEPAEPTCPAPAHDLQLLPQQAGMASILATAVINKDVFPCKDCGIWYRSERNLQAHLLYYCASRQGTGSPAAAATDEKPKETYPNERVCPFPQCRKSCPSASSLEIHMRSHSGERPFVCLICLSAFTTKANCERHLKVHTDTLSGVCHSCGFISTTRDILYSHLVTNHMVCQPGSKGEIYSPGAGHPATKLPPDSLGSFQQQHTALQGPLASADLGLAPTPSPGLDRKALAEATNGEARAEPLAQNGGSSEPPAAPRSIKVEAVEEPEAAPILGPGEPGPQAPSRTPSPRSPAPARVKAELSSPTPGSSPVPGELGLAGALFLPQYVFGPDAAPPASEILAKMSELVHSRLQQGAGAGAGGAQTGLFPGAPKGATCFECEITFSNVNNYYVHKRLYCSGRRAPEDAPAARRPKAPPGPARAPPGQPAEPDAPRSSPGPGAREEGAGGAATPEDGAGGRGSEGSQSPGSSVDDAEDDPSRTLCEACNIRFSRHETYTVHKRYYCASRHDPPPRRPAAPPGPPGPAAPPAPSPAAPVRTRRRRKLYELHAAGAPPPPPPGHAPAPESPRPGSGSGSGPGLAPARSPGPAADGPIDLSKKPRRPLPGAPAPALADYHECTACRVSFHSLEAYLAHKKYSCPAAPPPGALGLPAAACPYCPPNGPVRGDLLEHFRLAHGLLLGAPLAGPGVEARTPADRGPSPAPAPAASPQPGSRGPRDGLGPEPQEPPPGPPPSPAAAPEAVPPPPAPPSYSDKGVQTPSKGTPAPLPNGNHRYCRLCNIKFSSLSTFIAHKKYYCSSHAAEHVK

SEQ ID NO: 38408 - protein, 158 aa, Homo sapiens
  ENSP00000482796
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPMRKLRLQDVKSIAQIPRIKQQREK

SEQ ID NO: 38409 - protein, 117 aa, Homo sapiens
  ENSP00000484216
MSRRKQSNPRQIKRSLGDMEAREEVQLVGASHMEQKATAPEAPSPPSADELEPVVQDGQRRIRARLSLATGLSWGPFHGSVQTRASSPRQAEPMRKLRLQDVKSIAQIPRIKQQREK

SEQ ID NO: 38410 - protein, 151 aa, Homo sapiens
  ENSP00000480412
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPRGAISALAPSVQTHRTR

SEQ ID NO: 38411 - protein, 1151 aa, Homo sapiens
  ENSP00000384179
MSRRKQSKPRQIKRPLEDAIEDEEEECPSEETDIISKGDFPLEESFSTEFGPENLSCEEVEYFCNKGDDEGIQETAESDGDTQSEKPGQPGVETDDWDGPGELEVFQKDGERKIQSRQQLPVGTTWGPFPGKMDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 38412 - protein, 1019 aa, Homo sapiens
  ENSP00000430757
MDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 38413 - protein, 26 aa, Homo sapiens
  ENSP00000428149
MDLNNNSLKTKAQVPMVLTAGPKWLL

SEQ ID NO: 38414 - protein, 1019 aa, Homo sapiens; identical to SEQ ID NO: 38412
  ENSP00000428720

SEQ ID NO: 38415 - protein, 135 aa, Homo sapiens
  ENSP00000411637
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLT

SEQ ID NO: 38416 - protein, 31 aa, Homo sapiens
  ENSP00000416298
MDEDGLELQQEPNSFFDATGADGTHMDGDQI

SEQ ID NO: 38417 - protein, 805 aa, Homo sapiens
  ENSP00000368475
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 38418 - protein, 805 aa, Homo sapiens; identical to SEQ ID NO: 38417
  ENSP00000304985

SEQ ID NO: 38419 - protein, 755 aa, Homo sapiens
  ENSP00000343384
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISCGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 38420 - protein, 844 aa, Homo sapiens
  ENSP00000368486
MDEDGLELQQEPNSFFDATDRVSFCHPGWSTVAPSGSTATSASQAQVICSASRVTGATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 38421 - protein, 576 aa, Homo sapiens
  ENSP00000438233
MTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 38422 - protein, 801 aa, Homo sapiens
  ENSP00000372525
MDEDEFELQPQEPNSFFDGIGADATHMDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 38423 - protein, 610 aa, Homo sapiens
  ENSP00000485605
MDEDEFELQPQEPNSFFDGIVDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 38424 - protein, 91 aa, Homo sapiens
  ENSP00000388814
MDEDEFELQPQEPNSFFDGIGADATHMDGDQIVVEIQEAVFVSNIVDSDITVHNFVPDDPDSVVIQDVVEDVVIEEDVQCSDILEEADVSE

SEQ ID NO: 38425 - protein, 724 aa, Homo sapiens
  ENSP00000393908
MDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLSNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 38426 - protein, 801 aa, Homo sapiens; identical to SEQ ID NO: 38422
  ENSP00000155093

SEQ ID NO: 38427 - protein, 136 aa, Homo sapiens
  ENSP00000419664
  MOD_RES (1)..(1): Any amino acid
XPFGADSRLQSQAPDSGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 38428 - protein, 447 aa, Homo sapiens
  ENSP00000282928
MLLDAGPQYPAIGVTTFGASRHHSAGDVAERDVGLGINPFADGMGAFKLNPSSHELASAGQTAFTSQAPGYAAAAALGHHHHPGHVGSYSSAAFNSTRDFLFRNRGFGDAAAAASAQHSLFAASAGGFGGPHGHTDAAGHLLFPGLHEQAAGHASPNVVNGQMRLGFSGDMYPRPEQYGQVTSPRSEHYAAPQLHGYGPMNVNMAAHHGAGAFFRYMRQPIKQELICKWIEPEQLANPKKSCNKTFSTMHELVTHVTVEHVGGPEQSNHICFWEECPREGKPFKAKYKLVNHIRVHTGEKPFPCPFPGCGKVFARSENLKIHKRTHTGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 38429 - protein, 532 aa, Homo sapiens
  ENSP00000365514
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 38430 - protein, 467 aa, Homo sapiens
  ENSP00000287538
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKVHESQGSDSSPAASSGYESSTPPAIASANSKDTTKTPSAVQTSTSHNPGLPPNFNEWYV

SEQ ID NO: 38431 - protein, 457 aa, Homo sapiens
  ENSP00000359638
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKCCPAWYPGQSLIPDEELDTDVGMQQPALHNTTYPKCRVNAEPTVQEMIY

SEQ ID NO: 38432 - protein, 334 aa, Homo sapiens
  ENSP00000372553
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 38433 - protein, 334 aa, Homo sapiens; identical to SEQ ID NO: 38432
  ENSP00000417855

SEQ ID NO: 38434 - protein, 334 aa, Homo sapiens; identical to SEQ ID NO: 38432
  ENSP00000420775

SEQ ID NO: 38435 - protein, 128 aa, Homo sapiens
  ENSP00000418277
MRYKTSLVMRKRLRLYRNTLKESSEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 38436 - protein, 229 aa, Homo sapiens
  ENSP00000420627
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHT

SEQ ID NO: 38437 - protein, 77 aa, Homo sapiens
  ENSP00000418343
MRYKTSLVMRKRLRLYRNTLKESSSSSGHHGPQLTAASSPSVFPGLHEEPPQASPSRPLNGLLRLGLPGDMYARPEP

SEQ ID NO: 38438 - protein, 68 aa, Homo sapiens
  ENSP00000419727
MRYKTSLVMRKRLRLYRNTLKESSSSSGHHGPQLTAASSPSVFPGLHEEPPQASPSRPLNGLLRLGLP

SEQ ID NO: 38439 - protein, 372 aa, Homo sapiens
  ENSP00000397695
MNGPCQSLRKAEGLLEGCTSAVTVFRKLPLDSKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 38440 - protein, 384 aa, Homo sapiens
  ENSP00000435509
MPPFCRNAKLGLLSFLICAGRSLLPLGKNAFWLERIENNNTLWEKAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 38441 - protein, 663 aa, Homo sapiens
  ENSP00000267294
MFLKAGRGNKVPPVRVYGPDCVVLMEPPLSKRNPPALRLADLATAQVQPLQNMTGFPALAGPPAHSQLRAAVAHLRLRDLGADPGVATTPLGPEHMAQASTLGLSPPSQAFPAHPEAPAAAARAAALVAHPGAGSYPCGGGSSGAQPSAPPPPAPPLPPTPSPPPPPPPPPPPALSGYTTTNSGGGGSSGKGHSRDFVLRRDLSATAPAAAMHGAPLGGEQRSGTGSPQHPAPPPHSAGMFISASGTYAGPDGSGGPALFPALHDTPGAPGGHPHPLNGQMRLGLAAAAAAAAAELYGRAEPPFAPRSGDAHYGAVAAAAAAALHGYGAVNLNLNLAAAAAAAAAGPGPHLQHHAPPPAPPPPPAPAQHPHQHHPHLPGAAGAFLRYMRQPIKQELICKWIDPDELAGLPPPPPPPPPPPPPPPAGGAKPCSKTFGTMHELVNHVTVEHVGGPEQSSHVCFWEDCPREGKPFKAKYKLINHIRVHTGEKPFPCPFPGCGKVFARSENLKIHKRTHTGEKPFKCEFDGCDRKFANSSDRKKHSHVHTSDKPYYCKIRGCDKSYTHPSSLRKHMKIHCKSPPPSPGPLGYSSVGTPVGAPLSPVLDPARSHSSTLSPQVTNLNEWYVCQASGAPSHLHTPSSNGTTSETEDEEIYGNPEVVRTIH

SEQ ID NO: 38442 - protein, 563 aa, Homo sapiens
  ENSP00000323148
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 38443 - protein, 527 aa, Homo sapiens
  ENSP00000409172
MWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 38444 - protein, 125 aa, Homo sapiens
  ENSP00000394445
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGE

SEQ ID NO: 38445 - protein, 527 aa, Homo sapiens; identical to SEQ ID NO: 38443
  ENSP00000480305

SEQ ID NO: 38446 - protein, 350 aa, Homo sapiens
  ENSP00000443508
MASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 38447 - protein, 153 aa, Homo sapiens
  ENSP00000319785
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTGLRRNYRCTICSVSLNSIEQYHAHLKGSKHQTNLKNK

SEQ ID NO: 38448 - protein, 229 aa, Homo sapiens
  ENSP00000297737
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIEQYHAHLKGSKHQTNLKNK

SEQ ID NO: 38449 - protein, 211 aa, Homo sapiens
  ENSP00000428423
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIE

SEQ ID NO: 38450 - protein, 61 aa, Homo sapiens
  ENSP00000430050
MKSSDIDQDLFTDSYCKVCSAQLISESQRVAHYEGPEFLRKGNFIRHTKPKEDVTLKKVAV

SEQ ID NO: 38451 - protein, 46 aa, Homo sapiens
  ENSP00000427918
MKSSDIDQDLFTDSYCKVCSAQLISESQRVAHYECGAVPLGMSNVT

SEQ ID NO: 38452 - protein, 46 aa, Homo sapiens; identical to SEQ ID NO: 38451
  ENSP00000429068

SEQ ID NO: 38453 - protein, 43 aa, Homo sapiens
  ENSP00000445997
MDAKSLTAWSRTLVTFKDVFVDFTREEWKLLDTAQQIVYRNVM

SEQ ID NO: 38454 - protein, 47 aa, Homo sapiens
  ENSP00000438232
MDAKSLTAWSRTLVTFKDVFVDFTREEWKLLDTAQQIVYRNVMLENY

SEQ ID NO: 38455 - protein, 573 aa, Homo sapiens
  ENSP00000248211
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 38456 - protein, 72 aa, Homo sapiens
  ENSP00000441339
MDAKSLTAWSRTLVTFKDVFVDFTREEWKLLDTAQQIVYRNVMLENYKNLVSLGYQLTKPDVILRLEKGEEP

SEQ ID NO: 38457 - protein, 573 aa, Homo sapiens; identical to SEQ ID NO: 38455
  ENSP00000393814

SEQ ID NO: 38458 - protein, 439 aa, Homo sapiens
  ENSP00000384893
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 38459 - protein, 73 aa, Homo sapiens
  ENSP00000462445
MSGHPGSWEMNSVAFEDVAVNFTQEEWALLDPSQKNLYRDVMQETFRNLASIGNKGEDQSIEDQYKNSSRNLR

SEQ ID NO: 38460 - protein, 77 aa, Homo sapiens
  ENSP00000463191
MSGHPGSWEMNSVAFEDVAVNFTQEEWALLDPSQKNLYRDVMQETFRNLASIGNKGEDQSIEDQYKNSSRNLRCTGS

SEQ ID NO: 38461 - protein, 289 aa, Homo sapiens
  ENSP00000340749
MSGHPGSWEMNSVAFEDVAVNFTQEEWALLDPSQKNLYRDVMQETFRNLASIGNKGEDQSIEDQYKNSSRNLSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 38462 - protein, 351 aa, Homo sapiens
  ENSP00000440365
MSGHPGSWEMNSVAFEDVAVNFTQEEWALLDPSQKNLYRDVMQETFRNLASIGNKGEDQSIEDQYKNSSRNLRHIISHSGNNPYGCEECGKKPCTCKQCQKTSLSVTRVHRDTVMHTGNGHYGCTICEKVFNIPSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 38463 - protein, 79 aa, Homo sapiens
  ENSP00000427003
MGSRYVPRLASNSWAELLLPNSASQSAGITSVSHRARPHLFLQSSPTAMEAEETMECLQEFPEHHKMILDRLNEQREQD

SEQ ID NO: 38464 - protein, 264 aa, Homo sapiens
  ENSP00000422079
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYL

SEQ ID NO: 38465 - protein, 253 aa, Homo sapiens
  ENSP00000425623
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGAHEITLH

SEQ ID NO: 38466 - protein, 623 aa, Homo sapiens
  ENSP00000426504
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGIEIVELQLSHVKDLFHCEKCNRSFKLFYHFKEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 38467 - protein, 151 aa, Homo sapiens
  ENSP00000422659
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETS

SEQ ID NO: 38468 - protein, 83 aa, Homo sapiens
  ENSP00000425139
MEAEETMECLQEFPEHHKMILDRLNEQREQDRFTDITLIVDGHHFKAHKAVLAACSKFFYKFFQEFTQEPLVEIEGTKKTQLP

SEQ ID NO: 38469 - protein, 589 aa, Homo sapiens
  ENSP00000305804
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 38470 - protein, 589 aa, Homo sapiens; identical to SEQ ID NO: 38469
  ENSP00000423945

SEQ ID NO: 38471 - protein, 589 aa, Homo sapiens; identical to SEQ ID NO: 38469
  ENSP00000421246

SEQ ID NO: 38472 - protein, 139 aa, Homo sapiens
  ENSP00000424771
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGK

SEQ ID NO: 38473 - protein, 66 aa, Homo sapiens
  ENSP00000425722
MEAEETMECLQEFPEHHKMILDRLNEQREQDRFTDITLIVDGHHFKAHKAVLAACSHVLPQIFSIL

SEQ ID NO: 38474 - protein, 124 aa, Homo sapiens
  ENSP00000426614
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVR

SEQ ID NO: 38475 - protein, 68 aa, Homo sapiens
  ENSP00000423254
  MOD_RES (1)..(1): Any amino acid
XKKQRTGKKIHVCQYCEKQFDHFGHFKEHLRKHTVLDAKKFTVMRPHLVRALPVATLQSPEAMQGITW

SEQ ID NO: 38476 - protein, 201 aa, Homo sapiens
  ENSP00000425799
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKNSSISMTTSPF

SEQ ID NO: 38477 - protein, 113 aa, Homo sapiens
  ENSP00000424403
MELLTFRDVAIEFSPEEWKCLDPDQQNLYRDVMLENYRNLVSLGVAISNPDLVTCLEQRKEPYNVKIHKIVARPPEFFHLYDNKPILAFWRIASEKSQSASVYRQLTHRSRAT

SEQ ID NO: 38478 - protein, 474 aa, Homo sapiens
  ENSP00000240499
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKVIHAGEKPYTCEECGKAFKWSLIFNEHKRIHTGEKPFTCEECGSIFTTSSHFAKHKIIHTGEKPYKCEECGKAFNRFTTLTKHKRIHAGEKPITCEECRKIFTSSSNFAKHKRIHTGEKPYKCEECGKAFNRSTTLTKHKRIHTGEKPYTCEECGKAFRQSSKLNEHKKVHTGERPYKCDECGKAFGRSRVLNEHKKIHTGEKPYKCEECGKAFRRSTDRSQHKKIHSADKPYKCKECDKAFKQFSLLSQHKKIHTVDKPYKCKDCDKAFKRFSHLNKHKKIHT

SEQ ID NO: 38479 - protein, 751 aa, Homo sapiens
  ENSP00000366636
MEDLSSPDSTLLQGGHNLLSSASFQEAVTFKDVIVDFTQEEWKQLDPGQRDLFRDVTLENYTHLVSIGLQVSKPDVISQLEQGTEPWIMEPSIPVGTCADWETRLENSVSAPEPDISEEELSPEVIVEKHKRDDSWSSNLLESWEYEGSLERQQANQQTLPKEIKVTEKTIPSWEKGPVNNEFGKSVNVSSNLVTQEPSPEETSTKRSIKQNSNPVKKEKSCKCNECGKAFSYCSALIRHQRTHTGEKPYKCNECEKAFSRSENLINHQRIHTGDKPYKCDQCGKGFIEGPSLTQHQRIHTGEKPYKCDECGKAFSQRTHLVQHQRIHTGEKPYTCNECGKAFSQRGHFMEHQKIHTGEKPFKCDECDKTFTRSTHLTQHQKIHTGEKTYKCNECGKAFNGPSTFIRHHMIHTGEKPYECNECGKAFSQHSNLTQHQKTHTGEKPYDCAECGKSFSYWSSLAQHLKIHTGEKPYKCNECGKAFSYCSSLTQHRRIHTREKPFECSECGKAFSYLSNLNQHQKTHTQEKAYECKECGKAFIRSSSLAKHERIHTGEKPYQCHECGKTFSYGSSLIQHRKIHTGERPYKCNECGRAFNQNIHLTQHKRIHTGAKPYECAECGKAFRHCSSLAQHQKTHTEEKPYQCNKCEKTFSQSSHLTQHQRIHTGEKPYKCNECDKAFSRSTHLTEHQNTHTGEKPYNCNECRKTFSQSTYLIQHQRIHSGEKPFGCNDCGKSFRYRSALNKHQRLHPGI

SEQ ID NO: 38480 - protein, 751 aa, Homo sapiens; identical to SEQ ID NO: 38479
  ENSP00000211936

SEQ ID NO: 38481 - protein, 495 aa, Homo sapiens
  ENSP00000338572
MAESAPARHRRKRRSTPLTSSTLPSQATEKSSYFQTTEISLWTVVAAIQAVEKKMESQAARLQSLEGRTGTAEKKLADCEKMAVEFGNQLEGKWAVLGTLLQEYGLLQRRLENVENLLRNRNFWILRLPPGSKGEAPKVSRSLENDGVCFTEQEWENLEDWQKELYRNVMESNYETLVSLKVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 38482 - protein, 50 aa, Homo sapiens
  ENSP00000418281
MAESAPARVKRHRRAGSRARWGWRSPLPGAGLRGLDAAGVLVSRGCRWRG

SEQ ID NO: 38483 - protein, 50 aa, Homo sapiens; identical to SEQ ID NO: 38482
  ENSP00000418167

SEQ ID NO: 38484 - protein, 194 aa, Homo sapiens
  ENSP00000419419
  MOD_RES (1)..(1): Any amino acid
XYGLLQRRLENVENLLRNRNFWILRLPPGSKGEAPKVSRSLENDGVCFTEQEWENLEDWQKELYRNVMESNYETLVSLSSSDSPASASRVAEITEVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPS

SEQ ID NO: 38485 - protein, 69 aa, Homo sapiens
  ENSP00000419261
  MOD_RES (1)..(1): Any amino acid
XCFTEQEWENLEDWQKELYRNVMESNYETLVSLKSCSIAQAGVQWHNLGSLQPLPHRFKRFSCLSLSSS

SEQ ID NO: 38486 - protein, 722 aa, Homo sapiens
  ENSP00000354206
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRHHREQRSGAGPGPPPEPPPPSQRGSAPQSGAKPSPQPATWVEGASSPRPPSSGAGPGSRRKPASPGRTLRNGRGGEAEPLDLSLRAGPGGEAGPGGALHRCLFCPFATGAPELMALHLQVHHSRRARGRRPPQADASPPYARVPSGETPPSPSQEGEEGSGLSRPGEAGLGGQER

SEQ ID NO: 38487 - protein, 722 aa, Homo sapiens; identical to SEQ ID NO: 38486
  ENSP00000388558

SEQ ID NO: 38488 - protein, 722 aa, Homo sapiens; identical to SEQ ID NO: 38486
  ENSP00000392401

SEQ ID NO: 38489 - protein, 211 aa, Homo sapiens
  ENSP00000450803
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTA

SEQ ID NO: 38490 - protein, 158 aa, Homo sapiens
  ENSP00000451212
MLGQKERQSQLLPCSTAPVAFISSFSSSSLHFPEPKNVKGVHGDLSPQGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERP

SEQ ID NO: 38491 - protein, 111 aa, Homo sapiens
  ENSP00000450609
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPER

SEQ ID NO: 38492 - protein, 145 aa, Homo sapiens
  ENSP00000451890
MNPIRSTAPVAFISSFSSSSLHFPEPKNVKGVHGDLSPQGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQ

SEQ ID NO: 38493 - protein, 107 aa, Homo sapiens
  ENSP00000450900
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTH

SEQ ID NO: 38494 - protein, 57 aa, Homo sapiens
  ENSP00000451969
MGAVSWSESRAGERRFPCPVCGKRFRFNSILALHLRAHPGAQAFQCPHCGHRAAQRA

SEQ ID NO: 38495 - protein, 31 aa, Homo sapiens
  ENSP00000451595
MEGSRPRAPSGHLAPSPPAFDGELDLQRYSN

SEQ ID NO: 38496 - protein, 214 aa, Homo sapiens
  ENSP00000467235
MERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVH

SEQ ID NO: 38497 - protein, 499 aa, Homo sapiens
  ENSP00000468720
MGPLQFRDVAIEFSLEEWHCLDTAQRNLYRDVMLENYRNLVFLGIVVSKPDLVTCLEQGKKPLTMERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVHTGEKPYKCEECGKAFKHPSHVTTHKKIHTRGKPYNCEECGKSFKHCSNLTIHKRIHTGEKPYKCEECGKAFHLSSHLTTHKILHTGEKPYRCRECGKAFNHSTTLFSHEKIHTGEKPYKCDECGKTFTWPSILSKHKRTHTGEKPYKCEECGKSFTASSTLTTHKRIHTGEKPYKCEECGKAFNWSSDLNKHKKIHIERKPYIVKNVTDLLNVPPLLISIR

SEQ ID NO: 38498 - protein, 423 aa, Homo sapiens
  ENSP00000347868
MSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVHTGEKPYKCEECGKAFKHPSHVTTHKKIHTRGKPYNCEECGKSFKHCSNLTIHKRIHTGEKPYKCEECGKAFHLSSHLTTHKILHTGEKPYRCRECGKAFNHSTTLFSHEKIHTGEKPYKCDECGKTFTWPSILSKHKRTHTGEKPYKCEECGKSFTASSTLTTHKRIHTGEKPYKCEECGKAFNWSSDLNKHKKIHIERKPYIVKNVTDLLNVPPLLISIR

SEQ ID NO: 38499 - protein, 274 aa, Homo sapiens
  ENSP00000492582
GPLQFRDVAIEFSLEEWHCLDTAQRNLYRDVMLENYRNLVFLGIVVSKPDLVTCLEQGKKPLTMERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYKCEECGKAFNWSSDLNKHKKIHIERKPYIVKNVTDLLNVPPLLISIR

SEQ ID NO: 38500 - protein, 706 aa, Homo sapiens
  ENSP00000401642
MAAAVLMDRVQSCVTFEDVFVYFSREEWELLEEAQRFLYRDVMLENFALVATLAFIFPVPCSCAVGGGRKPWVPDRADITAATVKETYRGHGPAEWELEEGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 38501 - protein, 617 aa, Homo sapiens
  ENSP00000470319
MLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 38502 - protein, 659 aa, Homo sapiens
  ENSP00000282286
MAAAVLMDRVQSCVTFEDVFVYFSREEWELLEEAQRFLYRDVMLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 38503 - protein, 659 aa, Homo sapiens; identical to SEQ ID NO: 38502
  ENSP00000375586

SEQ ID NO: 38504 - protein, 463 aa, Homo sapiens
  ENSP00000253144
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQHQKIHTGEKPYECKDCGKAFRWGSSLVIHKRIHTGEKPYECKDCGKAFRRGDELTQHQRFHTGEKDYECKDCGKTFSRVYKLIQHKRIHSGEKPYECKDCGKAFICGSSLIQHKRIHTGEKPYECQECGKAFTRVNYLTQHQKIHTGEKPHECKECGKAFRWGSSLVKHERIHTGEKPYKCTECGKAFNCGYHLTQHERIHTGETPYKCKECGKAFIYGSSLVKHERIHTGVKPYGCTECGKSFSHGHQLTQHQKTHSGAKSYECKECGKACNHLNHLREHQRIHNS

SEQ ID NO: 38505 - protein, 63 aa, Homo sapiens
  ENSP00000423675
MAQGLVTFADVAIDFSQEEWACLNSAQRDLYWDVMLENYSNLVSLDLESAYENKSLPTEKNIH

SEQ ID NO: 38506 - protein, 463 aa, Homo sapiens; identical to SEQ ID NO: 38504
  ENSP00000427439

SEQ ID NO: 38507 - protein, 99 aa, Homo sapiens
  ENSP00000424835
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRY

SEQ ID NO: 38508 - protein, 463 aa, Homo sapiens; identical to SEQ ID NO: 38504
  ENSP00000393336

SEQ ID NO: 38509 - protein, 463 aa, Homo sapiens; identical to SEQ ID NO: 38504
  ENSP00000421014

SEQ ID NO: 38510 - protein, 86 aa, Homo sapiens
  ENSP00000423263
MAQGLVTFADVAIDFSQEEWACLNSAQRDLYWDVMLENYSNLVSLDLESAYENKSLPTEKNIHEIRASKRNSDRRSKSLGRNWICE

SEQ ID NO: 38511 - protein, 47 aa, Homo sapiens
  ENSP00000426155
MAQGLVTFADVAIDFSQEEWACLNSAQRDLYWDVMLENYSNLVSLDL

SEQ ID NO: 38512 - protein, 463 aa, Homo sapiens; identical to SEQ ID NO: 38504
  ENSP00000423156

SEQ ID NO: 38513 - protein, 463 aa, Homo sapiens; identical to SEQ ID NO: 38504
  ENSP00000421728

SEQ ID NO: 38514 - protein, 105 aa, Homo sapiens
  ENSP00000426127
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMII

SEQ ID NO: 38515 - protein, 166 aa, Homo sapiens
  ENSP00000422471
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKK

SEQ ID NO: 38516 - protein, 177 aa, Homo sapiens
  ENSP00000427532
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQH

SEQ ID NO: 38517 - protein, 98 aa, Homo sapiens
  ENSP00000426458
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGR

SEQ ID NO: 38518 - protein, 85 aa, Homo sapiens
  ENSP00000422586
MAQGLVTFADVAIDFSQEEWACLNSAQRDLYWDVMLENYSNLVSLDLESAYENKSLPTEKNIHEIRASKRNSDRRSKSLGRNWIC

SEQ ID NO: 38519 - protein, 66 aa, Homo sapiens
  ENSP00000425517
MAQGLVTFADVAIDFSQEEWACLNSAQRDLYWDVMLENYSNLVSLDLESAYENKSLPTEKNIHEIR

SEQ ID NO: 38520 - protein, 64 aa, Homo sapiens
  ENSP00000424929
MAQGLVTFADVAIDFSQEEWACLNSAQRDLYWDVMLENYSNLVSLDLESAYENKSLPTEKNIHE

SEQ ID NO: 38521 - protein, 463 aa, Homo sapiens; identical to SEQ ID NO: 38504
  ENSP00000393817

SEQ ID NO: 38522 - protein, 552 aa, Homo sapiens
  ENSP00000466051
MARVPLTFSDVAIDFSQEEWEYLNSDQRDLYRDVMLENYTNLVSLDFNFTTESNKLSSEKRNYEVNAYHQETWKRNKTFNLMRFIFRTDPQYTIEFGRQQRPKVGCFSQMIFKKHKSLPLHKRNNTREKSYECKEYKKGFRKYLHLTEHLRDHTGVIPYECNECGKAFVVFQHFIRHRKIHTDLKPYECNGCEKAFRFYSQLIQHQIIHTGMKPYECKQCGKAFRRHSHLTEHQKIHVGLKPFECKECGETFRLYRHMCLHQKIHHGVKPYKCKECGKAFGHRSSLYQHKKIHSGEKPYKCEQCEKAFVRSYLLVEHQRSHTGEKPHECMECGKAFGKGSSLLKHKRIHSSEKLYDCKDCGKAFCRGSQLTQHQRIHTGEKPHECKECGKTFKLHSYLIQHQIIHTDLKPYECKQCGKAFSRVGDLKTHQSIHAGEKPYECKECGKTFRLNSQLIYHQTIHTGLKPYVCKECKKAFRSISGLSQHKRIHTGEKPYECKECDKAFNRSDRLTQHETIHTGVKPQKCKECGKAFSHCYQLSQHQRFHHGERLLM

SEQ ID NO: 38523 - protein, 551 aa, Homo sapiens
  ENSP00000319479
FQVPLTFSDVAIDFSQEEWEYLNSDQRDLYRDVMLENYTNLVSLDFNFTTESNKLSSEKRNYEVNAYHQETWKRNKTFNLMRFIFRTDPQYTIEFGRQQRPKVGCFSQMIFKKHKSLPLHKRNNTREKSYECKEYKKGFRKYLHLTEHLRDHTGVIPYECNECGKAFVVFQHFIRHRKIHTDLKPYECNGCEKAFRFYSQLIQHQIIHTGMKPYECKQCGKAFRRHSHLTEHQKIHVGLKPFECKECGETFRLYRHMCLHQKIHHGVKPYKCKECGKAFGHRSSLYQHKKIHSGEKPYKCEQCEKAFVRSYLLVEHQRSHTGEKPHECMECGKAFGKGSSLLKHKRIHSSEKLYDCKDCGKAFCRGSQLTQHQRIHTGEKPHECKECGKTFKLHSYLIQHQIIHTDLKPYECKQCGKAFSRVGDLKTHQSIHAGEKPYECKECGKTFRLNSQLIYHQTIHTGLKPYVCKECKKAFRSISGLSQHKRIHTGEKPYECKECDKAFNRSDRLTQHETIHTGVKPQKCKECGKAFSHCYQLSQHQRFHHGERLLM

SEQ ID NO: 38524 - protein, 587 aa, Homo sapiens
  ENSP00000294753
MPTALCPRVLAPKESEEPRKMRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 38525 - protein, 512 aa, Homo sapiens
  ENSP00000473324
QAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPRIFQFNNHRSNGYILEMLGSGGKKAQIISVLSQIYVSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 38526 - protein, 139 aa, Homo sapiens
  ENSP00000469334
MEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQ

SEQ ID NO: 38527 - protein, 37 aa, Homo sapiens
  ENSP00000470423
MQSLVLLPRLECSDVILAYCNLHLPGKLHEPKWQRLQ

SEQ ID NO: 38528 - protein, 126 aa, Homo sapiens
  ENSP00000469168
MEETQGELTSSCGSKTMANVSLAFRDVSIDLSQEEWECLDAVQRDLYKDVMLENYSNLVSLGYTIPKPDVITLLEQEKEPWIVMREGTRNWFTESRSVTQAGVQWHNLGSLQPPPPGFKQFFCLSL

SEQ ID NO: 38529 - protein, 810 aa, Homo sapiens
  ENSP00000469540
MQPRFLWILCFSMEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQCKHEFERQERHQMGCVSQMLIQKQISHPLHPKIHAREKSYECKECRKAFRQQSYLIQHLRIHTGERPYKCMECGKAFCRVGDLRVHHTIHAGERPYECKECGKAFRLHYHLTEHQRIHSGVKPYECKECGKAFSRVRDLRVHQTIHAGERPYECKECGKAFRLHYQLTEHQRIHTGERPYECKVCGKTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYICNECGKAFRLQGELTRHHRIHTCEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISEEVLCIM

SEQ ID NO: 38530 - protein, 836 aa, Homo sapiens
  ENSP00000339823
MQVDPPLHGPPNDFLIFQIIPLHSLSIMPRFLWILCFSMEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQCKHEFERQERHQMGCVSQMLIQKQISHPLHPKIHAREKSYECKECRKAFRQQSYLIQHLRIHTGERPYKCMECGKAFCRVGDLRVHHTIHAGERPYECKECGKAFRLHYHLTEHQRIHSGVKPYECKECGKAFSRVRDLRVHQTIHAGERPYECKECGKAFRLHYQLTEHQRIHTGERPYECKVCGKTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYICNECGKAFRLQGELTRHHRIHTCEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISEEVLCIM

SEQ ID NO: 38531 - protein, 124 aa, Homo sapiens
  ENSP00000472403
MQVDPPLHGPPNDFLIFQIIPLHSLSIMPRFLWILCFSMEETQGELTSSCGSKTMANVSLAFRDVSIDLSQEEWECLDAVQRDLYKDVMLENYSNLVSLGYTIPKPDVITLLEQEKEPWIVMRE

SEQ ID NO: 38532 - protein, 139 aa, Homo sapiens; identical to SEQ ID NO: 38526
  ENSP00000486015

SEQ ID NO: 38533 - protein, 37 aa, Homo sapiens; identical to SEQ ID NO: 38527
  ENSP00000487382

SEQ ID NO: 38534 - protein, 126 aa, Homo sapiens; identical to SEQ ID NO: 38528
  ENSP00000486807

SEQ ID NO: 38535 - protein, 810 aa, Homo sapiens; identical to SEQ ID NO: 38529
  ENSP00000487351

SEQ ID NO: 38536 - protein, 836 aa, Homo sapiens; identical to SEQ ID NO: 38530
  ENSP00000487125

SEQ ID NO: 38537 - protein, 124 aa, Homo sapiens; identical to SEQ ID NO: 38531
  ENSP00000486294

SEQ ID NO: 38538 - protein, 103 aa, Homo sapiens
  ENSP00000468407
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFAS

SEQ ID NO: 38539 - protein, 172 aa, Homo sapiens
  ENSP00000320050
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 38540 - protein, 22 aa, Homo sapiens
  ENSP00000465028
MLLLPPRPPHPRSSSPEAMDPP

SEQ ID NO: 38541 - protein, 172 aa, Homo sapiens; identical to SEQ ID NO: 38539
  ENSP00000443957

SEQ ID NO: 38542 - protein, 104 aa, Homo sapiens
  ENSP00000467142
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASP

SEQ ID NO: 38543 - protein, 172 aa, Homo sapiens; identical to SEQ ID NO: 38539
  ENSP00000446126

SEQ ID NO: 38544 - protein, 113 aa, Homo sapiens
  ENSP00000466825
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPAPCLVNSHHLQESFRG

SEQ ID NO: 38545 - protein, 769 aa, Homo sapiens
  ENSP00000292841
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 38546 - protein, 714 aa, Homo sapiens
  ENSP00000375998
MLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 38547 - protein, 25 aa, Homo sapiens
  ENSP00000466185
MPANWTSPQKSSALAPEDHGSSYEC

SEQ ID NO: 38548 - protein, 714 aa, Homo sapiens; identical to SEQ ID NO: 38546
  ENSP00000349440

SEQ ID NO: 38549 - protein, 696 aa, Homo sapiens
  ENSP00000347338
MSYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 38550 - protein, 695 aa, Homo sapiens
  ENSP00000438015
MSYGSITFGDVAIDFSHQEWEYLSLVQKTLYQEVMMENYDNLVSLGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 38551 - protein, 102 aa, Homo sapiens
  ENSP00000466265
MSYGSITFGDVAIDFSHQEWEYLSLVQKTLYQEVMMENYDNLVSLGHSVSKPDLITLLEQGKEPWMIVREETRGECTAELQSKNCGFQLRDLQDSLHLRKNC

SEQ ID NO: 38552 - protein, 112 aa, Homo sapiens
  ENSP00000466785
MQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECG

SEQ ID NO: 38553 - protein, 70 aa, Homo sapiens
  ENSP00000468817
MSYGSITFGDVAIDFSHQEWEYLSLVQKTLYQEVMMENYDNLVSLDLDSRCEIISDGKMQLYRKHSCVTL

SEQ ID NO: 38554 - protein, 590 aa, Homo sapiens
  ENSP00000332325
MSDSPAGSNPRTPESSGSGSGGGGKRPAVPAAVSLLPPADPLRQANRLPIRVLKMLSAHTGHLLHPEYLQPLSSTPVSPIELDAKKSPLALLAQTCSQIGKPDPPPSSKLNSVAAAANGLGAEKDPGRSAPGAASAAAALKQLGDSPAEDKSSFKPYSKGSGGGDSRKDSGSSSVSSTSSSSSSSPGDKAGFRVPSAACPPFPPHGAPVSASSSSSSPGGSRGGSPHHSDCKNGGGVGGGELDKKDQEPKPSPEPAAVSRGGGGEPGAHGGAESGASGRKSEPPSALVGAGHVAPVSPYKPGHSVFPLPPSSIGYHGSIVGAYAGYPSQFVPGLDPSKSGLVGGQLSGGLGLPPGKPPSSSPLTGASPPSFLQGLCRDPYCLGGYHGASHLGGSSCSTCSAHDPAGPSLKAGGYPLVYPGHPLQPAALSSSAAQAALPGHPLYTYGFMLQNEPLPHSCNWVAASGPCDKRFATSEELLSHLRTHTALPGAEKLLAAYPGASGLGSAAAAAAAAASCHLHLPPPAAPGSPGSLSLRNPHTLGLSRYHPYGKSHLSTAGGLAVPSLPTAGPYYSPYALYGQRLASASALGYQ

SEQ ID NO: 38555 - protein, 761 aa, Homo sapiens
  ENSP00000362260
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDIRDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 38556 - protein, 761 aa, Homo sapiens; identical to SEQ ID NO: 38555
  ENSP00000276123

SEQ ID NO: 38557 - protein, 807 aa, Homo sapiens
  ENSP00000353922
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDISCAEIADEVYMEVIVGEEEGTSLPEIQLEDSDVNKTVVPVVWAAAYGDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 38558 - protein, 10 aa, Homo sapiens
  ENSP00000391083
MGVLTFRDVA

SEQ ID NO: 38559 - protein, 427 aa, Homo sapiens
  ENSP00000400852
MGVLTFRDVAVEFSPEEWECLDSAQQRLYRDVMLENYGNLVSLGLAIFKPDLMTCLEQRKEPWKVKRQEAVAKHPAGSFHFTAEILPDHDIKDSFQKVILRKYGSCDLNNLHLKKDYQSVGNCKGQKSSYNGLHQCLSATHSKTCQCNKCGRGFQLCSIFTEHKDIFSREKCHKCEECGKDCRLFSDFTRHKKIHTVERCYKCEECGKAFKKFSNLTEHKRVHTGEKPYKCEGCGKTFTCSSTLVKHKRNHTGDRPYKCEECGKAFKCFSDLTNHKRIHTGEKPYKCEECNKAYRWFSDLAKHKIIHTGDKPYTCNECGKAFKWFSALSKHKRIHTGEKPYICEECGKAFTRSSTLFNHKRIHMEERPYKCEECSKTFKCFSDLTNHKRIHTGEKPYKCEECGKASSWFSHLIRHKRIHTREKLHKC

SEQ ID NO: 38560 - protein, 427 aa, Homo sapiens; identical to SEQ ID NO: 38559
  ENSP00000347210

SEQ ID NO: 38561 - protein, 737 aa, Homo sapiens
  ENSP00000437949
MTMLQESFSFDDLSVDFTQKEWQLLDPSQKNLYKDVMLENYSSLVSLGYEVMKPDVIFKLEQGEEPWVGDGEIPSSDSPVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFGCGNCGKTFPQKSQFITHHRTHTGEKPYNCSQCGKAFSQKSQLTSHQRTHTGEKPYECGECGKAFSRKSHLISHWRTHTGEKPYGCNECGRAFSEKSNLINHQRIHTGEKPFECRECGKAFSRKSQLVTHHRTHTGTKPFGCSDCRKAFFEKSELIRHQTIHTGEKPYECSECRKAFRERSSLINHQRTHTGEKPHGCIQCGKAFSQKSHLISHQMTHTGEKPFICSKCGKAFSRKSQLVRHQRTHTGEKPYECSECGKAFSEKLSLTNHQRIHTGEKPYVCSECGKAFCQKSHLISHQRTHTGEKPYECSECGKAFGEKSSLATHQRTHTGEKPYECRDCEKAFSQKSQLNTHQRIHTGEKPYECSLCRKAFFEKSELIRHLRTHTGEKPYECNECRKAFREKSSLINHQRIHTGEKPFECSECGKAFSRKSHLIPHQRTHTGEKPYGCSECRKAFSQKSQLVNHQRIHTGEKPYRCIECGKAFSQKSQLINHQRTHTVKKS

SEQ ID NO: 38562 - protein, 738 aa, Homo sapiens
  ENSP00000445549
MTMLQESFSFDDLSVDFTQKEWQLLDPSQKNLYKDVMLENYSSLVSLGYEVMKPDVIFKLEQGEEPWVGDGEIPSSDSPEVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFGCGNCGKTFPQKSQFITHHRTHTGEKPYNCSQCGKAFSQKSQLTSHQRTHTGEKPYECGECGKAFSRKSHLISHWRTHTGEKPYGCNECGRAFSEKSNLINHQRIHTGEKPFECRECGKAFSRKSQLVTHHRTHTGTKPFGCSDCRKAFFEKSELIRHQTIHTGEKPYECSECRKAFRERSSLINHQRTHTGEKPHGCIQCGKAFSQKSHLISHQMTHTGEKPFICSKCGKAFSRKSQLVRHQRTHTGEKPYECSECGKAFSEKLSLTNHQRIHTGEKPYVCSECGKAFCQKSHLISHQRTHTGEKPYECSECGKAFGEKSSLATHQRTHTGEKPYECRDCEKAFSQKSQLNTHQRIHTGEKPYECSLCRKAFFEKSELIRHLRTHTGEKPYECNECRKAFREKSSLINHQRIHTGEKPFECSECGKAFSRKSHLIPHQRTHTGEKPYGCSECRKAFSQKSQLVNHQRIHTGEKPYRCIECGKAFSQKSQLINHQRTHTVKKS

SEQ ID NO: 38563 - protein, 69 aa, Homo sapiens
  ENSP00000387416
MTMLQESFSFDDLSVDFTQKEWQLLDPSQKNLYKDVMLENYSSLVSLGYEVMKPDVIFKLEQGEEPWVG

SEQ ID NO: 38564 - protein, 236 aa, Homo sapiens
  ENSP00000445820
MTMLQESFSFDDLSVDFTQKEWQLLDPSQKNLYKDVMLENYSSLVSLGYEVMKPDVIFKLEQGEEPWVGDGEIPSSDSPEVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFG

SEQ ID NO: 38565 - protein, 55 aa, Homo sapiens
  ENSP00000445958
MTMLQESFSFDDLSVDFTQKEWQLLDPSQKNLYKDVMLENYSSLVSLGYEVMKPD

SEQ ID NO: 38566 - protein, 738 aa, Homo sapiens; identical to SEQ ID NO: 38562
  ENSP00000331465

SEQ ID NO: 38567 - protein, 78 aa, Homo sapiens
  ENSP00000438982
MTMLQESFSFDDLSVDFTQKEWQLLDPSQKNLYKDVMLENYSSLVSLGYEVMKPDVIFKLEQGEEPWVGDGEIPSSDS

SEQ ID NO: 38568 - protein, 6 aa, Homo sapiens
  ENSP00000437636
MTMLQV

SEQ ID NO: 38569 - protein, 84 aa, Homo sapiens
  ENSP00000442963
MTMLQESFSFDDLSVDFTQKEWQLLDPSQKNLYKDVMLENYSSLVSLGYEVMKPDVIFKLEQGEEPWVGDGEIPSSDSPGTSIV

SEQ ID NO: 38570 - protein, 145 aa, Homo sapiens
  ENSP00000439130
MTMLQESFSFDDLSVDFTQKEWQLLDPSQKNLYKDVMLENYSSLVSLGYEVMKPDVIFKLEQGEEPWVGDGEIPSSDSPVSGCFLPHGETWSAVREKNEAMMKAKSRKSPDCVPVPGSSGLHVQVHLCPFHVLIVEFFCEILQIS

SEQ ID NO: 38571 - protein, 738 aa, Homo sapiens; identical to SEQ ID NO: 38562
  ENSP00000376133

SEQ ID NO: 38572 - protein, 544 aa, Homo sapiens
  ENSP00000437590
MAVMDLSSPWALTKQDSACFHLRNAEEERMIAVFLTTWLQEPMTFKDVAVEFTQEEWMMLDSAQRSLYRDVMLENYRNLTSVEYQLYRLTVISPLDQEEIRNMKKRIPQAICPDQKIQPKTKESTVQKILWEEPSNAVKMIKLTMHNWSSTLREDWECHKIRKQHKIPGGHWRQMIYAPKKTVPQELFRDYHELEENSKLGSKLIFSQSIFTSKHCQKCYSEIGCLKHNSIINNYVKNSISEKLYESHECDTTLWHFQRNQTVQKEYTYSKHGMHFTHNMFPVPNNLHMAQNACECNKDETLCHQSSLKKQGQTHTEKKHECNQCGKAFKRISNLTLYKKSHMGEKQYECKECGKVFNDSSTLRRHVRTHTGEKPYECNQCGKAFSQKTSLKAHMRTHTGEKPYECNQCGKSFGTSSYLIVHKRIHTGEKLYECSECGKAFNTSSHLKVHKKIHTGENVYECSDCGKVFSGVSSLRMHIRTHTGEKPYECKECRKAFSVSSSLRRHVRIHTGEKPYECIQCGKAFSQSSSLIIHKRIHTERETL

SEQ ID NO: 38573 - protein, 154 aa, Homo sapiens
  ENSP00000304593
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGPNYLTACAGPPSRPQRPFCAVCGFPSPYTCVSCGARYCTVRCLGTHQETRCLKWTV

SEQ ID NO: 38574 - protein, 126 aa, Homo sapiens
  ENSP00000399966
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 38575 - protein, 126 aa, Homo sapiens; identical to SEQ ID NO: 38574
  ENSP00000402198

SEQ ID NO: 38576 - protein, 126 aa, Homo sapiens; identical to SEQ ID NO: 38574
  ENSP00000414110

SEQ ID NO: 38577 - protein, 126 aa, Homo sapiens; identical to SEQ ID NO: 38574
  ENSP00000387914

SEQ ID NO: 38578 - protein, 126 aa, Homo sapiens; identical to SEQ ID NO: 38574
  ENSP00000412369

SEQ ID NO: 38579 - protein, 126 aa, Homo sapiens; identical to SEQ ID NO: 38574
  ENSP00000395397

SEQ ID NO: 38580 - protein, 126 aa, Homo sapiens; identical to SEQ ID NO: 38574
  ENSP00000405636

SEQ ID NO: 38581 - protein, 126 aa, Homo sapiens; identical to SEQ ID NO: 38574
  ENSP00000391809

SEQ ID NO: 38582 - protein, 126 aa, Homo sapiens; identical to SEQ ID NO: 38574
  ENSP00000407715

SEQ ID NO: 38583 - protein, 126 aa, Homo sapiens; identical to SEQ ID NO: 38574
  ENSP00000410954

SEQ ID NO: 38584 - protein, 126 aa, Homo sapiens; identical to SEQ ID NO: 38574
  ENSP00000413265

SEQ ID NO: 38585 - protein, 126 aa, Homo sapiens; identical to SEQ ID NO: 38574
  ENSP00000395065

SEQ ID NO: 38586 - protein, 126 aa, Homo sapiens; identical to SEQ ID NO: 38574
  ENSP00000414720

SEQ ID NO: 38587 - protein, 126 aa, Homo sapiens; identical to SEQ ID NO: 38574
  ENSP00000410530

SEQ ID NO: 38588 - protein, 126 aa, Homo sapiens; identical to SEQ ID NO: 38574
  ENSP00000399302

SEQ ID NO: 38589 - protein, 126 aa, Homo sapiens; identical to SEQ ID NO: 38574
  ENSP00000396661

SEQ ID NO: 38590 - protein, 126 aa, Homo sapiens; identical to SEQ ID NO: 38574
  ENSP00000383503

SEQ ID NO: 38591 - protein, 126 aa, Homo sapiens; identical to SEQ ID NO: 38574
  ENSP00000373108

SEQ ID NO: 38592 - protein, 126 aa, Homo sapiens; identical to SEQ ID NO: 38574
  ENSP00000383501

SEQ ID NO: 38593 - protein, 126 aa, Homo sapiens; identical to SEQ ID NO: 38574
  ENSP00000383500

SEQ ID NO: 38594 - protein, 126 aa, Homo sapiens; identical to SEQ ID NO: 38574
  ENSP00000410127

SEQ ID NO: 38595 - protein, 126 aa, Homo sapiens; identical to SEQ ID NO: 38574
  ENSP00000416599

SEQ ID NO: 38596 - protein, 126 aa, Homo sapiens; identical to SEQ ID NO: 38574
  ENSP00000393236

SEQ ID NO: 38597 - protein, 126 aa, Homo sapiens; identical to SEQ ID NO: 38574
  ENSP00000405264

SEQ ID NO: 38598 - protein, 126 aa, Homo sapiens; identical to SEQ ID NO: 38574
  ENSP00000397636

SEQ ID NO: 38599 - protein, 126 aa, Homo sapiens; identical to SEQ ID NO: 38574
  ENSP00000407364

SEQ ID NO: 38600 - protein, 126 aa, Homo sapiens; identical to SEQ ID NO: 38574
  ENSP00000394779

SEQ ID NO: 38601 - protein, 126 aa, Homo sapiens; identical to SEQ ID NO: 38574
  ENSP00000396922

SEQ ID NO: 38602 - protein, 126 aa, Homo sapiens; identical to SEQ ID NO: 38574
  ENSP00000331111

SEQ ID NO: 38603 - protein, 126 aa, Homo sapiens; identical to SEQ ID NO: 38574
  ENSP00000365978

SEQ ID NO: 38604 - protein, 126 aa, Homo sapiens; identical to SEQ ID NO: 38574
  ENSP00000352333

SEQ ID NO: 38605 - protein, 126 aa, Homo sapiens; identical to SEQ ID NO: 38574
  ENSP00000365981

SEQ ID NO: 38606 - protein, 227 aa, Homo sapiens
  ENSP00000335091
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKSCIDSWFEVNRSCPEHPAD

SEQ ID NO: 38607 - protein, 278 aa, Homo sapiens
  ENSP00000323362
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNGRIQRSLRGAQPEKTWLSGRTLQEQPWRTECSWAPMAQMQSYPHCPVENREDDVLTKDAGECVICLEELLQGDTIARLPCLCIYHKSCIDSWFEVNRSCPEHPAD

SEQ ID NO: 38608 - protein, 209 aa, Homo sapiens
  ENSP00000456168
MGGKQSTAARSRGPFPGVSTDDSAVPPPGGAPHFGHYRTGGGAMGLRSRSVSSVAGMGMDPSTAGGVPFGLYTPASRGTGDSERAPGGGGSASDSTYAHGNGYQETGGGHHRDGMLYLGSRASLADALPLHIAPRWFSSHSGFKCPICSKSVASDEMEMHFIMCLSKPRLSYNDDVLTKDAGECVICLEELLQGDTIARLPCLCIYHKR

SEQ ID NO: 38609 - protein, 227 aa, Homo sapiens; identical to SEQ ID NO: 38606
  ENSP00000455601

SEQ ID NO: 38610 - protein, 52 aa, Homo sapiens
  ENSP00000462910
MEMHFIMCLSKPRLSYNDDVLTKDAGECVICLEELLQGDTIARLPCLCIYHK

SEQ ID NO: 38611 - protein, 78 aa, Homo sapiens
  ENSP00000457606
  MOD_RES (1)..(1): Any amino acid
XDVLTKDAGECVICLEELLQGDTIARLPCLCIYHKRDRAPLLQGGGSPDPGAELSLGHQREQGTPSALTSRSWFSLPP

SEQ ID NO: 38612 - protein, 736 aa, Homo sapiens
  ENSP00000458991
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 38613 - protein, 745 aa, Homo sapiens
  ENSP00000460971
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRMTVKCSYSRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 38614 - protein, 736 aa, Homo sapiens; identical to SEQ ID NO: 38612
  ENSP00000491583

SEQ ID NO: 38615 - protein, 745 aa, Homo sapiens; identical to SEQ ID NO: 38613
  ENSP00000492703

SEQ ID NO: 38616 - protein, 852 aa, Homo sapiens
  ENSP00000380174
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 38617 - protein, 199 aa, Homo sapiens
  ENSP00000457835
MMAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGWSKESHGSQICWALRRKNFQVAAT

SEQ ID NO: 38618 - protein, 556 aa, Homo sapiens
  ENSP00000456089
MAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVLKLDLRMKIIQNGIFLRKYNCIGHYLQDLKGKFPGIFIRVKAMRVTVDQEDSGQRPQGRKEEN

SEQ ID NO: 38619 - protein, 462 aa, Homo sapiens
  ENSP00000456883
MAKSALRENGTNSETFRQRFRRFHYQEVAGPREAFSQLWELCCRWLRPEVRTKEQIVELLVLEQFLTVLPGEIQNWVQEQCPENGEEAVTLVEDLEREPGRPRSSVTVSVKGQEVRLEKMTPPKSSQELLSVRQESVEPQPRGVPKKERARSPDLGPQEQMNPKEKLKPFQRSGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 38620 - protein, 330 aa, Homo sapiens
  ENSP00000454548
EQCPENGEEAVTLVEDLEREPGRPRSSVTVSVKGQEVRLEKMTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGA

SEQ ID NO: 38621 - protein, 21 aa, Homo sapiens
  ENSP00000458119
MMAKSALRENGTNSETFRQRF

SEQ ID NO: 38622 - protein, 316 aa, Homo sapiens
  ENSP00000380170
MSRKWRGGSDSRGRFRKRAWKTIFGHSLCEGAGSALGEDDTPEIITRVIKCSAGVSGTPAQGCTQEREGKKPRPGTTGADEPKGEAQTFSKERLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGA

SEQ ID NO: 38623 - protein, 494 aa, Homo sapiens
  ENSP00000329738
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQDTTHGQEMFWQEMTSTGALKSLSLNSPVQPLENQCKTETQESQAFQERDGRMVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 38624 - protein, 494 aa, Homo sapiens; identical to SEQ ID NO: 38623
  ENSP00000392371

SEQ ID NO: 38625 - protein, 221 aa, Homo sapiens
  ENSP00000465046
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQDTTHGQEMFWQEMTSTGALKSLSLNSPVQPLENQCKTETQESQAFQERDGVSLYHPGWSAVVQPQLTAAALNPWVKVILLPQPPE

SEQ ID NO: 38626 - protein, 91 aa, Homo sapiens
  ENSP00000470677
ELQAWLREHRPENGEEAVTMLEELEKELEEPRQQDTTHGQEMFWQEMTSTGALKSLSLNSPVQPLENQCKTETQESQAFQERGEKPQSMWG

SEQ ID NO: 38627 - protein, 51 aa, Homo sapiens
  ENSP00000472179
MSGEATVLAYHAPEEQEGLLVVKVEEENYVLDQDFGLQENPWSQEKCSGRK

SEQ ID NO: 38628 - protein, 145 aa, Homo sapiens
  ENSP00000470443
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQEFSACVSSE

SEQ ID NO: 38629 - protein, 69 aa, Homo sapiens
  ENSP00000468180
MSGEATVLAYHAPEEQEGLLVVKVEEENYVLDQDFGLQENPWSQEVFRQKFRQFSYSDSTGPREALSRL

SEQ ID NO: 38630 - protein, 47 aa, Homo sapiens
  ENSP00000467308
MSGEATVLAYHAPEEQEGLLVVKVEEENYVLDQDFGLQENPWSQEVF

SEQ ID NO: 38631 - protein, 307 aa, Homo sapiens
  ENSP00000480152
MVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 38632 - protein, 435 aa, Homo sapiens [sequence omitted]

SEQ ID NO: 38633 - protein, 1215 aa, Homo sapiens
  ENSP00000252744
MAERGQQPPPAKRLCCRPGGGGGGGGSSGGGGGAGGGYSSACRPGPRAGGAAAAAACGGGAALGLLPPGKTQSPESLLDIAARRVAEKWPFQRVEERFERIPEPVQRRIVYWSFPRSEREICMYSSFNTGGGAAGGPGDDSGGGGGAGGGGGGGSSSSPAATSAAATSAAAAAAAAAAAAAAAAGAGAPSVGAAGAADGGDETRLPFRRGIALLESGCVDNVLQVGFHLSGTVTEPAIQSEPETVCNVAISFDRCKITSVTCSCGNKDIFYCAHVVALSLYRIRKPDQVKLHLPISETLFQMNRDQLQKFVQYLITVHHTEVLPTAQKLADEILSQNSEINQVHGAPDPTAGASIDDENCWHLDEEQVQEQVKLFLSQGGYHGSGKQLNLLFAKVREMLKMRDSNGARMLTLITEQFMADPRLSLWRQQGTAMTDKYRQLWDELGALWMCIVLNPHCKLEQKASWLKQLKKWNSVDVCPWEDGNHGSELPNLTNALPQGANANQDSSNRPHRTVFTRAIEACDLHWQDSHLQHIISSDLYTNYCYHDDTENSLFDSRGWPLWHEHVPTACARVDALRSHGYPREALRLAIAIVNTLRRQQQKQLEMFRTQKKELPHKNITSITNLEGWVGHPLDPVGTLFSSLMEACRIDDENLSGFSDFTENMGQCKSLEYQHLPAHKFLEEGESYLTLAVEVALIGLGQQRIMPDGLYTQEKVCRNEEQLISKLQEIELDDTLVKIFRKQAVFLLEAGPYSGLGEIIHRESVPMHTFAKYLFTSLLPHDAELAYKIALRAMRLLVLESTAPSGDLTRPHHIASVVPNRYPRWFTLSHIESQQCELASTMLTAAKGDVRRLETVLESIQKNIHSSSHIFKLAQDAFKIATLMDSLPDITLLKVSLELGLQVMRMTLSTLNWRRREMVRWLVTCATEVGVYALDSIMQTWFTLFTPTEATSIVATTVMSNSTIVRLHLDCHQQEKLASSARTLALQCAMKDPQNCALSALTLCEKDHIAFETAYQIVLDAATTGMSYTQLFTIARYMEHRGYPMRAYKLATLAMTHLNLSYNQDTHPAINDVLWACALSHSLGKNELAAIIPLVVKSVKCATVLSDILRRCTLTTPGMVGLHGRRNSGKLMSLDKAPLRQLLDATIGAYINTTHSRLTHISPRHYSEFIEFLSKARETFLMAHDGHIQFTQFIDNLKQIYKGKKKLMMLVRERFG

SEQ ID NO: 38634 - protein, 417 aa, Homo sapiens
  ENSP00000360587
MSQISEALSRYRNRSCFVKEALHRLFTETFSMEVTMPAILKLVAIGMRNHPLDLRVQFTASACALNLTRQGLAKGMPVRLLSEVTCLLFKALKNFPHYQQLQKNCLLSLTNSRILVDVPFDRFDAAKFVMRWLCKHENPKMQTMAVSVTSILALQLSPEQTAQLEELFMAVKELLAIVKQKTTENLDDVTFLFTLKALWNLTDGSPAACKHFIENQGLQIFIQVLETFSESAIQSKVLGLLNNIAEVRELSSKLVTEDVLKHINSLLCSREMEVSYFAAGIIAHLTSDRQLWISRDFQRRTLLQDLHATIQNWPSSSCKMTALVTYRSFKTFFPLLGNFSQPEVQLWALWAMYHVCSKNPSKYCKMLVEEEGLQLLCDIQEHSEATPKAQQIAASILDDFRMHFMNYQRPTLCQMPF

SEQ ID NO: 38635 - protein, 759 aa, Homo sapiens
  ENSP00000360583
MVHFLHPGHTPRNIVPPDAQKDALGCCVVQEEASPYTLVNICLNVLIANLEKLCSERPDGTLCLPEHWSFPQEVAERFLRVMTWQGKLTDRTASIFRGNQMKLKLVNIQKAKISTAAFIKAFCRHKLIELNATAVHADLPVPDIISGLCSNRWIQQNLQCLLLDSTSIPQNSRLLFFSQLTGLRILSVFNVCFHTEDLANVSQLPRLESLDISNTLVTDISALLTCKDRLKSLTMHYLKCLAMTKSQILAVIRELKCLLHLDISDHRQLKSDLAFHLLQQKDILPNVVSLDISGGNCITDEAVELFIRLRPAMQFVGLLATDAGSSDFFTTKQGLRVAGGASMSQISEALSRYRNRSCFVKEALHRLFTETFSMEVTMPAILKLVAIGMRNHPLDLRVQFTASACALNLTRQGLAKGMPVRLLSEVTCLLFKALKNFPHYQQLQKNCLLSLTNSRILVDVPFDRFDAAKFVMRWLCKHENPKMQTMAVSVTSILALQLSPEQTAQLEELFMAVKELLAIVKQKTTENLDDVTFLFTLKALWNLTDGSPAACKHFIENQGLQIFIQVLETFSESAIQSKVLGLLNNIAEVRELSSKLVTEDVLKHINSLLCSREMEVSYFAAGIIAHLTSDRQLWISRDFQRRTLLQDLHATIQNWPSSSCKMTALVTYRSFKTFFPLLGNFSQPEVQLWALWAMYHVCSKNPSKYCKMLVEEEGLQLLCDIQEHSEATPKAQQIAASILDDFRMHFMNYQRPTLCQMPF

SEQ ID NO: 38636 - protein, 417 aa, Homo sapiens; identical to SEQ ID NO: 38634
  ENSP00000482761

SEQ ID NO: 38637 - protein, 572 aa, Homo sapiens
  ENSP00000324422
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 38638 - protein, 177 aa, Homo sapiens
  ENSP00000413467
PSVCPSPPGWRLLRTGTQSLRTRRRGGHPRRGAHAPACDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQP

SEQ ID NO: 38639 - protein, 164 aa, Homo sapiens
  ENSP00000400537
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPF

SEQ ID NO: 38640 - protein, 540 aa, Homo sapiens
  ENSP00000346417
AAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 38641 - protein, 415 aa, Homo sapiens
  ENSP00000376642
MTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 38642 - protein, 176 aa, Homo sapiens
  ENSP00000411230
  MOD_RES (1)..(1): Any amino acid
XSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQGLLSSRQAGCAPLGPQGP

SEQ ID NO: 38643 - protein, 171 aa, Homo sapiens
  ENSP00000403714
MSTYTRTQHRKKCQGPVSFAESWAAQQQAGRVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTS

SEQ ID NO: 38644 - protein, 124 aa, Homo sapiens
  ENSP00000482745
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGM

SEQ ID NO: 38645 - protein, 216 aa, Homo sapiens
  ENSP00000482745
DLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 38646 - protein, 124 aa, Homo sapiens; identical to SEQ ID NO: 38644
  ENSP00000424038

SEQ ID NO: 38647 - protein, 216 aa, Homo sapiens; identical to SEQ ID NO: 38645
  ENSP00000424038

SEQ ID NO: 38648 - protein, 40 aa, Homo sapiens
  ENSP00000426427
MADISSDGEREANMPGLNIRNKEFNYLHNRNGSELDLLGM

SEQ ID NO: 38649 - protein, 99 aa, Homo sapiens
  ENSP00000426427
DLLENLGYSVVIKENLTAQMVLGLFGSPLTVEKPVQILMVGSCKVTSVMMLLQRLMWKRTSLLSNLPHHIMFLGDMKQMALSSFPKLSTTSESILGVII

SEQ ID NO: 38650 - protein, 124 aa, Homo sapiens; identical to SEQ ID NO: 38644
  ENSP00000425652

SEQ ID NO: 38651 - protein, 152 aa, Homo sapiens
  ENSP00000425652
DLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPRSTFI

SEQ ID NO: 38652 - protein, 124 aa, Homo sapiens; identical to SEQ ID NO: 38644
  ENSP00000423970

SEQ ID NO: 38653 - protein, 170 aa, Homo sapiens
  ENSP00000423970
DLLENLGYSVVIKENLTAQEMETALRQFAAHPEHQSSDSTFLVFMSHSILNGICGTKHWDQEPDVLHDDTIFEIFNNRNCQSLKDKPKMVLGLFGSPLTVEKPVQILMVGSCKVTSVMMLLQRLMWKRTSLLSNLPHHVQHSFETPNILTQLPTIERLSMTRYFYLFPGN

SEQ ID NO: 38654 - protein, 40 aa, Homo sapiens; identical to SEQ ID NO: 38648
  ENSP00000427437

SEQ ID NO: 38655 - protein, 101 aa, Homo sapiens
  ENSP00000427437
DLLENLGYSVVIKENLTAQMVLGLFGSPLTVEKPVQILMVGSCKVTSVMMLLQRLMWKRTSLLSNLPHHVQHSFETPNILTQLPTIERLSMTRYFYLFPGN

SEQ ID NO: 38656 - protein, 124 aa, Homo sapiens; identical to SEQ ID NO: 38644
  ENSP00000423899

SEQ ID NO: 38657 - protein, 99 aa, Homo sapiens; identical to SEQ ID NO: 38649
  ENSP00000423899

SEQ ID NO: 38658 - protein, 124 aa, Homo sapiens; identical to SEQ ID NO: 38644
  ENSP00000421815

SEQ ID NO: 38659 - protein, 101 aa, Homo sapiens; identical to SEQ ID NO: 38655
  ENSP00000421815

SEQ ID NO: 38660 - protein, 40 aa, Homo sapiens; identical to SEQ ID NO: 38648
  ENSP00000426566

SEQ ID NO: 38661 - protein, 216 aa, Homo sapiens; identical to SEQ ID NO: 38645
  ENSP00000426566
